US012674169B2

(12) United States Patent
Brown et al.

(10) Patent No.: US 12,674,169 B2
(45) Date of Patent: Jul. 7, 2026

(54) **COMPOSITIONS AND METHODS FOR MODULATING *SCAP* ACTIVITY**

(71) Applicant: Dicerna Pharmaceuticals, Inc., Lexington, MA (US)

(72) Inventors: Bob Dale Brown, Littleton, MA (US); Henryk T. Dudek, Belmont, MA (US); Seongmoon Cheong, Harvard, MA (US); Nicole Alexis Spiegelman, Somerville, MA (US)

(73) Assignee: Dicerna Pharmaceuticals, Inc., Lexington, MA (US)

( * ) Notice: Subject to any disclaimer, the term of this patent is extended or adjusted under 35 U.S.C. 154(b) by 535 days.

(21) Appl. No.: 18/300,937

(22) Filed: Apr. 14, 2023

(65) Prior Publication Data

US 2023/0374522 A1 Nov. 23, 2023

Related U.S. Application Data

(60) Provisional application No. 63/363,091, filed on Apr. 15, 2022.

(51) Int. Cl.
*C12N 15/113* (2010.01)

(52) U.S. Cl.
CPC ...... *C12N 15/1138* (2013.01); *C12N 2310/14* (2013.01); *C12N 2310/312* (2013.01); *C12N 2310/3125* (2013.01); *C12N 2310/315* (2013.01); *C12N 2310/321* (2013.01);
(Continued)

(58) Field of Classification Search
CPC ............. C12N 15/113; C12N 15/1138; C12N 2310/14; C12N 2310/312; C12N 2310/315; C12N 2310/321; C12N 2310/322; C12N 2310/343; C12N 2310/351; C12N 2310/531; A61K 31/713
See application file for complete search history.

(56) References Cited

U.S. PATENT DOCUMENTS

| | | | |
|---|---|---|---|
| 8,372,968 | B2 | 2/2013 | Tuschl et al. |
| 8,513,207 | B2 | 8/2013 | Brown |
| 8,883,996 | B2 | 11/2014 | Rossi et al. |

(Continued)

FOREIGN PATENT DOCUMENTS

| | | | |
|---|---|---|---|
| WO | 2010033225 | A2 | 3/2010 |
| WO | 2017100542 | A1 | 6/2017 |

(Continued)

OTHER PUBLICATIONS

Anon, "Taking RNAi under the skin," 2016; https://media.nature.com/original/magazine-assets/d43747-020-00189-y/d43747-020-00189-y.pdf.

(Continued)

*Primary Examiner* — Terra C Gibbs
(74) *Attorney, Agent, or Firm* — Wolf, Greenfield & Sacks, P.C.

(57) ABSTRACT

Oligonucleotides and compositions including the same are disclosed that modulate (e.g., inhibit, limit or reduce) sterol regulatory element-binding protein (SREBP) cleavage-activating protein (SCAP) activity. Methods of making and using the oligonucleotides also are disclosed, particularly uses relating to treating diseases, disorders, and/or conditions associated with SCAP activity such as nonalcoholic fatty liver disease (NAFLD), (NASH), dyslipidemia, atherosclerotic cardiovascular disease (ASCVD), and/or other SCAP-associated conditions, diseases, and/or disorders.

20 Claims, 1 Drawing Sheet

Specification includes a Sequence Listing.

Modification Pattern 1: M1 (SM1405/ASM2028 pattern)

Key:

(52) U.S. Cl.
CPC .................. *C12N 2310/351* (2013.01); *C12N 2310/3521* (2013.01); *C12N 2310/531* (2013.01)

(56) References Cited

U.S. PATENT DOCUMENTS

| | | | |
|---|---|---|---|
| 8,927,705 | B2 | 1/2015 | Brown |
| 9,012,138 | B2 | 4/2015 | Tuschl et al. |
| 9,012,621 | B2 | 4/2015 | Tuschl et al. |
| 9,193,753 | B2 | 11/2015 | Tuschl et al. |

FOREIGN PATENT DOCUMENTS

| | | | |
|---|---|---|---|
| WO | 2020123083 | A1 | 6/2020 |
| WO | 2020243702 | A2 | 12/2020 |
| WO | 2021146488 | A1 | 7/2021 |
| WO | 2021188795 | A1 | 9/2021 |
| WO | 2022032288 | A1 | 2/2022 |
| WO | 2022077024 | A1 | 4/2022 |

OTHER PUBLICATIONS

Hu, et al., “Therapeutic siRNA: state of the art,” Singal Transduction and Targeted Therapy. 2020;5(1):1-25.

Setten, et al., “The current state and future directions of RNAi-based therapeutics,” Nature Reviews Drug Discovery, Nature Publishing Group. 2019;18(6).

PCT International Search Report and Written Opinion from PCT/US2023/018657, dated Oct. 2, 2023.

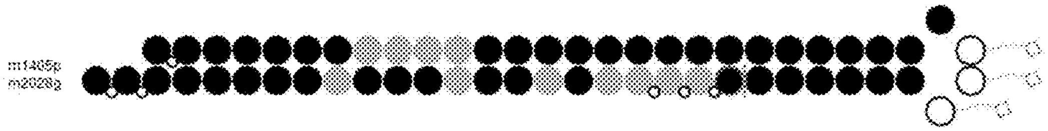
Modification Pattern 1: M1 (SM1405/ASM2028 pattern)
Key:
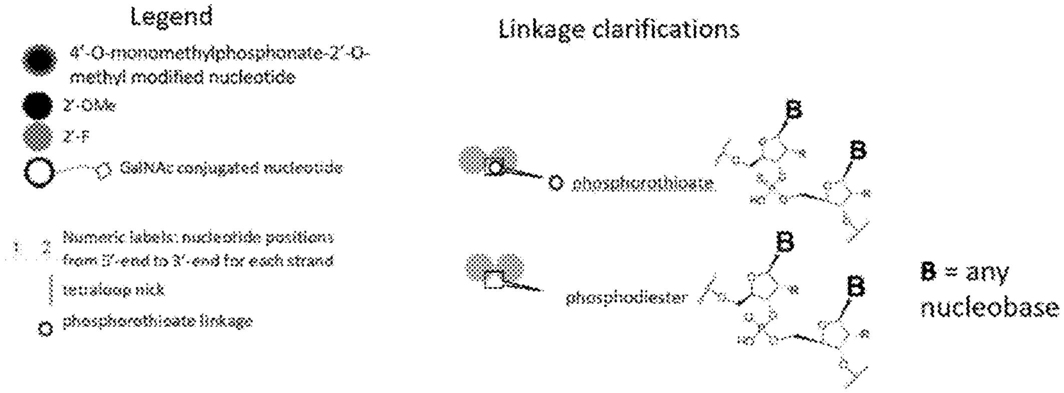

COMPOSITIONS AND METHODS FOR MODULATING *SCAP* ACTIVITY

CROSS-REFERENCE TO RELATED APPLICATIONS

The present application claims priority under 35 U.S.C. § 119(e) from U.S. Provisional Application No. 63/363,091, filed Apr. 15, 2022, which is incorporated herein by reference in its entirety.

SEQUENCE LISTING

The instant application contains a Sequence Listing which has been submitted electronically in XML format and is hereby incorporated by reference in its entirety. Said XML copy, created on Aug. 10, 2023, is named 199124_SL.xml and is 7,278,592 bytes in size.

TECHNICAL FIELD

The disclosure relates generally to biology and medicine, and more particularly it relates to oligonucleotides and compositions including the same for modulating (e.g., inhibiting or reducing) sterol regulatory element-binding protein (SREBP) cleavage-activating protein (SCAP) activity, as well as their use for treating conditions, diseases and/or disorders associated with SCAP.

BACKGROUND

SCAP is a cholesterol-binding endoplasmic reticulum (ER) membrane protein encoded by SCAP that binds and transports SREBP transcription factors from the ER to the Golgi apparatus for processing. Once processed in the Golgi apparatus, SREBP transcription factors migrate to the nucleus where they participate in regulating genes involved in lipid homeostasis. SREBP1a, SREBP1c and SREBP2 are regulated by the SREBP cleavage-activating protein (SCAP) encoded by the SCAP gene. SREBP1c is the most abundant SREBP in the liver and its regulation is important for maintaining lipid homeostasis. Specifically, SREBPs affect lipid homeostasis by modulating genes involved in lipid biosynthesis as well as modulating genes involved in lipid clearance (e.g., low-density lipoprotein receptor (LDLR) and proprotein convertase subtilisin/kexin type (PCSK9)). SCAP also plays a role in NLR family pyrin domain containing 3 (NLRP3) inflammasome activation.

Human SCAP is ubiquitously expressed throughout the body, but protein expression is highest in the bone marrow, brain, endocrine tissue, gastrointestinal tract, liver, lymphoid tissue, muscle tissue, pancreas, reproductive organs, and respiratory tract. The role SCAP plays in regulating the transcription of genes involved in lipid homeostasis make it a promising therapeutic target to attenuate NASH progression at various stages.

Despite the existence of some therapeutics toward SCAP, there is a need for additional therapeutics for inhibiting or reducing SCAP activity for treating liver disease, especially NAFLD and non-alcoholic steatohepatitis (NASH).

BRIEF SUMMARY

To address this need, the disclosure describes compositions for and methods of treating a disease, disorder and/or condition related to SCAP activity. The disclosure is based, in part, on discovering and developing double-stranded (ds) oligonucleotides (e.g., RNAi oligonucleotides) for selectively modulating (e.g., inhibiting and/or reducing) SCAP activity in, for example, the liver. Accordingly, target sequences within SCAP are identified, and RNAi oligonucleotides that bind to these target sequences and inhibit SCAP mRNA expression are generated. As shown herein, some oligonucleotides inhibit at least human and non-human primate (NHP) (i.e., double-common), while others inhibit mouse, human and NHP (i.e., triple-common) SCAP activity in the liver. Without being bound by theory, the RNAi oligonucleotides herein are useful for treating a disease, disorder and/or condition associated with SCAP activity (e.g., liver diseases such as, for example, NAFLD, NASH, dyslipidemia, and/or atherosclerotic cardiovascular disease (ASCVD)).

Accordingly, the disclosure describes RNAi oligonucleotides for reducing or inhibiting SCAP activity that include a sense strand (also known as a passenger strand) and/or an antisense strand (also known as a guide strand), where the sense strand has a sequence as set forth in Table 3, and where the antisense strand has a sequence as set forth in Table 3.

In some embodiments, the sense strand has a sequence as set forth in Table 3 (e.g., any one of the odd numbers of SEQ ID NOs: 9 to 392), especially any one of SEQ ID NOs: 139, 147, 221, 273, 321, 333, and 361.

In some embodiments, the antisense strand has a sequence as set forth in Table 3 (e.g., any one of the even numbers of SEQ ID NOs: 9 to 392), especially any one of SEQ ID NOs: 140, 148, 222, 274, 322, 334, and 362.

Alternatively, the disclosure describes RNAi oligonucleotides for reducing or inhibiting SCAP activity that include a sense strand and/or an antisense strand, where the sense strand has a sequence as set forth in Table 4, and where the antisense strand has a sequence as set forth in Table 4.

In some embodiments, the sense strand has a sequence as set forth in Table 4 (e.g., any one of the odd numbers of SEQ ID NOs: 393 to 776), especially any one of SEQ ID NOs: 523, 531, 605, 657, 705, 717, and 745.

In some embodiments, the antisense strand has a sequence as set forth in Table 4 (e.g., any one of the even numbers of SEQ ID NOs: 393 to 776), especially any one of SEQ ID NOs: 524, 532, 606, 658, 706, 718, and 746.

Alternatively, RNAi oligonucleotides are described for reducing or inhibiting SCAP activity that include a sense strand and an antisense strand, where the sense and antisense strands form a duplex region, and where the antisense strand has a region of complementarity to a SCAP mRNA target sequence of any one of SEQ ID NOs: 777 to 783.

In any of the embodiments above, the sense strand is from about 15 nucleotides to about 50 nucleotides in length. In some embodiments, the sense strand is from about 20 nucleotides to about 40 nucleotides in length. In some embodiments, the sense strand is 36 nucleotides in length.

In any of the embodiments above, the antisense strand is from about 15 nucleotides to about 30 nucleotides in length. In some embodiments, the antisense strand is from about 20 nucleotides to about 25 nucleotides. In some embodiments, the antisense strand is 22 nucleotides in length.

In any of the embodiments above, the duplex region is from about 19 nucleotides in length to about 21 nucleotides in length. In certain embodiment, the duplex region is 20 nucleotides in length.

In any of the embodiments above, the region of complementarity is at least 15 contiguous nucleotides in length. In some embodiments, the region of complementarity is from about 19 contiguous nucleotides in length to about 21 contiguous nucleotides in length. In other embodiments, the region of complementarity is 19 contiguous nucleotides in length or 21 contiguous nucleotides in length.

In any of the embodiments above, the RNAi oligonucleotides include on the sense strand a 3' end a stem-loop set forth as: S1-L-S2, where a first stem portion (S1) is complementary to a second stem portion (S2), and where L is a loop between S1 and S2 of about 3 to about 5 nucleotides in length.

In any of the embodiments above, the antisense strand, the sense strand, or both have an overhang sequence. In some embodiments, the antisense strand includes a 3' overhang of 1 or more nucleotides in length. In other embodiments, the 3' overhang sequence is 2 nucleotides in length such as, for example, GG.

Oligonucleotides also are described that include an antisense strand and a sense strand for reducing or inhibiting SCAP activity, where the antisense strand can be from about 21 nucleotides to about 27 nucleotides in length and has a region of complementarity to SCAP mRNA, wherein the sense strand includes a stem-loop at its 3' end set forth as: S1-L-S2, wherein S1 is complementary to S2, wherein L forms a loop between S1 and S2 from about 3 nucleotides to about 5 nucleotides in length, and wherein the antisense strand and the sense strand form a duplex structure of at least about 19 nucleotides in length but are not covalently linked.

In some embodiments, the loop L is a triloop (triL) or a tetraloop (tetraL). In some embodiments, L is a tetraL of 4 nucleotides in length. In certain embodiments, L is a tetraL having a sequence of 5'-GAAA-3'.

In some embodiments, S1 and S2 are 1-10 nucleotides in length and have the same length. In other embodiments, S1 and S2 are 1 nucleotide, 2 nucleotides, 3 nucleotides, 4 nucleotides, 5 nucleotides, 6 nucleotides, 7 nucleotides, 8 nucleotides, 9 nucleotides, or 10 nucleotides in length. In other embodiments, S1 and S2 are 6 nucleotides in length. In certain embodiments, the stem-loop comprises the sequence 5'-GCAGCCGAAAGGCUGC-3' (SEQ ID NO: 784).

In some embodiments, the sense strand is 25 nucleotides in length and the antisense strand is 27 nucleotides in length. In other embodiments, the sense strand is 36 nucleotides in length and the antisense strand is 22 nucleotides in length.

In the embodiments above, the duplex region includes a 3' overhang sequence on the antisense strand. In some embodiments, the 3' overhang sequence on the antisense strand is 2 nucleotides in length.

In any of the embodiments above, at least one nucleotide in an oligonucleotide is a modified nucleotide. In some embodiments, all nucleotides in the oligonucleotide are modified except for nucleotides in the stem-loop (i.e., S1-L-S2). In other embodiments, all nucleotides in the oligonucleotide are modified except for nucleotides in the L.

In some embodiments, the modified nucleotide includes a 2'-modification such as, for example, 2'-aminoethyl (EA), 2'-fluoro (2'-F), 2'-O-methyl (2'-OMe), 2'-O-methoxyethyl (2'-MOE) and 2'-deoxy-2'-fluoro-β-arabinonucleic acid (2'-FANA). In certain embodiments, all nucleotides in an oligonucleotide include a 2'-modification such as, for example, 2'-F or 2'-OMe. In some embodiments, about 18% to about 23%, or 18%, 19%, 20%, 21%, 22%, or 23% of the nucleotides of the sense strand comprise a 2'-F modification. In other embodiments, about 38% to about 43%, or 38%, 39%, 40%, 41%, 42%, or 43% of the nucleotides of the sense strand comprise a 2'-F modification. In some embodiments, about 25% to about 35%, or 25%, 26%, 27%, 28%, 29%, 30%, 31%, 32%, 33%, 34%, or 35% of the nucleotides of the antisense strand comprise a 2'-F modification. In some embodiments, about 25% to about 35%, or 25%, 26%, 27%, 28%, 29%, 30%, 31%, 32%, 33%, 34%, or 35% of the nucleotides of the oligonucleotide comprise a 2'-F modification. In some embodiments, about 35% to about 45%, or 35%, 36%, 37%, 38%, 39%, 40%, 41%, 42%, 43%, 44%, or 45% of the nucleotides of the oligonucleotide comprise a 2'-F modification.

In any of the embodiments above, at least one nucleotide in an oligonucleotide includes a modified internucleotide linkage. In some embodiments, the modified internucleotide linkage is a phosphorothioate (PS) linkage.

In any of the embodiments above, a 4'-carbon of a sugar of a 5'-nucleotide of the antisense strand includes a phosphate analog such as, for example, an oxymethylphosphonate, vinylphosphonate or malonylphosphonate. Alternatively, or optionally, the phosphate analog is a 4'-phosphate analog including 5'-methoxyphosphonate-4'-oxy.

In any of the embodiments above, at least one nucleotide of an oligonucleotide is conjugated to one or more targeting ligands such as, for example, an amino sugar, carbohydrate, cholesterol, lipid, or polypeptide. In some embodiments, the targeting ligand is a N-acetylgalactosamine (GalNAc) moiety. In other embodiments, the GalNAc moiety is a monovalent GalNAc moiety, a bivalent GalNAc moiety, a trivalent GalNAc moiety, or a tetravalent GalNAc moiety.

In some embodiments, the targeting ligands are conjugated to one or more nucleotides of L of the stem loop. In certain embodiments, up to 4 nucleotides of L of the stem-loop are each conjugated to a monovalent GalNAc moiety.

In certain embodiments, one or more nucleotides at positions 8, 9, 10, or 11 of the sense strand are modified with a 2'-F. In other embodiments, the sugar moiety at each nucleotide at positions 1 to 7, 12 to 27 and 31 to 36 in the sense strand is modified with a 2'-OMe. In certain embodiments, nucleotides at positions 8 to 11 of the sense strand are modified with a 2'-F, and positions 1 to 7, 12 to 27 and 31 to 36 are modified with a 2'-OMe.

In certain other embodiments, one or more nucleotides at positions 2 to 5, 7, 10 and 14 of the antisense strand are modified with 2'-F, and one or more nucleotides at positions 1, 6, 8-9, 11-13 and 15-22 modified with a 2'-OMe. In other embodiments, the antisense strand includes a 2'-F-modified nucleotide at positions 2 to 5, 7, 10 and 14, and a 2'-OMe-modified nucleotide at positions 1, 6, 8 to 9, 11 to 13 and 15 to 22.

In certain embodiments, the oligonucleotides have a modification pattern as shown in FIG. 1.

In any of the embodiments above, the oligonucleotide is a RNAi oligonucleotide. In some embodiments, the RNAi oligonucleotide includes a sense strand having a nucleotide sequence as set forth in Table 3, especially any one of SEQ ID NOs: 139, 147, 221, 273, 321, 333, and 361. In certain embodiments, the RNAi oligonucleotide includes a sense strand having a nucleotide sequence as set forth in Table 4, especially any one of SEQ ID NOs: 523, 531, 605, 657, 705, 717, and 745. In some embodiments, the RNAi oligonucleotide includes an antisense strand having a nucleotide sequence as set for the in Table 3, especially any one of SEQ ID NOs: 140, 148, 222, 274, 322, 334, and 362. In certain embodiments, the RNAi oligonucleotide includes an antisense strand having a nucleotide sequence as set forth in Table 4, especially any one of SEQ ID NOs: 524, 532, 606, 658, 706, 718, and 746.

In certain embodiments, the RNAi oligonucleotide includes a sense strand having a nucleotide sequence of any one of SEQ ID NOs: 139, 147, 221, 273, 321, 333, and 361, and an antisense strand having a nucleotide sequence of any one of SEQ ID NOs: 140, 148, 222, 274, 322, 334, and 362.

In certain other embodiments, the sense strand and the antisense strand of the RNAi oligonucleotide, respectively, are selected from:

(a) SEQ ID NOs: 139 and 140,
(b) SEQ ID NOs: 147 and 148,
(c) SEQ ID NOs: 221 and 222,
(d) SEQ ID NOs: 273 and 274,
(e) SEQ ID NOs: 321 and 322,
(f) SEQ ID NOs: 333 and 334, and
(g) SEQ ID NOs: 361 and 362.

In certain embodiments, the RNAi oligonucleotide includes a sense strand having a nucleotide sequence of any one of SEQ ID NOs: 147 and 333, and an antisense strand having a nucleotide sequence of any one of SEQ ID NOs: 148 and 334 respectively.

In certain embodiments, the RNAi oligonucleotide includes a sense strand having a nucleotide sequence of any one of SEQ ID NOs: 523, 531, 605, 657, 705, 717, and 745, and an antisense strand having a nucleotide sequence of any one of SEQ ID NOs: 524, 532, 606, 658, 706, 718, and 746 respectively.

In certain other embodiments, the sense strand and the antisense strand of the RNAi oligonucleotide, respectively, are selected from:

(a') SEQ ID NOs: 523 and 524,
(b') SEQ ID NOs: 531 and 532,
(c') SEQ ID NOs: 605 and 606,
(d') SEQ ID NOs: 657 and 658,
(e') SEQ ID NOs: 705 and 706,
(f') SEQ ID NOs: 717 and 718, and
(g') SEQ ID NOs: 745 and 746.

In certain embodiments, the RNAi oligonucleotide includes a sense strand having a nucleotide sequence of any one of SEQ ID NOs: 531 and 717, and an antisense strand having a nucleotide sequence of any one of SEQ ID NOs: 532 and 718 respectively.

RNAi oligonucleotides also are described for inhibiting or reducing SCAP activity that include a sense strand and an antisense strand, where the sense strand and the antisense strand form a duplex region, where all nucleotides of the sense strand and the antisense strand include a modification of a base, a sugar and/or an internucleotide linkage, where the antisense strand includes a region of complementarity to a SCAP mRNA target sequence of one of SEQ ID NOs: 777 to 783, and where the region of complementarity is at least about 15 contiguous nucleotides in length.

In other aspects, pharmaceutical compositions are described that include at least one oligonucleotide herein, or a pharmaceutically acceptable salt thereof, and a pharmaceutically acceptable carrier, delivery agent or excipient. In some embodiments, the pharmaceutical compositions include an additional therapeutic agent such as, for example, a lipid-lowering agent, an antidiabetic agent, or anti-obesity agent.

In other aspects, methods are described for reducing SCAP activity in a cell, a population of cells, a tissue, an organ, or an individual that include at least a step of administering/contacting the cell, the population of cells, the tissue, the organ, or the individual with an oligonucleotide herein or a pharmaceutical composition herein. In some embodiments, reducing SCAP activity includes reducing an amount or level of SCAP mRNA, an amount or level of SCAP protein, SCAP activity or a combination thereof in the cell, the population of cells, the tissue, the organ, or the individual. In some embodiments, the cell, the cell population, the tissue, the organ, or the individual has a disease, disorder, or condition associated with SCAP activity. In certain embodiments, the disease, disorder, or condition associated with SCAP activity is NAFLD, NASH, dyslipidemia, and/or ASCVD.

In other aspects, methods are described for treating an individual having or suspected of having a disease, disorder, or condition associated with SCAP activity. The methods include at least a step of administering to an individual in need thereof an effective amount of an oligonucleotide herein or a pharmaceutical composition herein. In some embodiments, the disease, disorder, or condition associated with SCAP activity is NAFLD, NASH, dyslipidemia, and/or ASCVD. In some embodiments, the oligonucleotide or pharmaceutical composition is administered daily, weekly, monthly, quarterly, yearly via subcutaneous (SQ) administration, especially monthly or quarterly.

In some embodiments, the individual has alcoholic hepatitis (AH), alcoholic liver disease (ALD), cholangiocarcinoma (CCA), cirrhosis, hepatic fibrosis, hepatic inflammation, hepatocellular carcinoma (HCC), liver steatosis, NAFLD, NASH, primary sclerosing cholangitis (PSC), hypercholesterolemia, hyperlipidemia, hypertriglyceridemia, diabetes, and/or obesity, and/or ASCVD.

In any of the embodiments above, the methods may comprise additional steps such as measuring or obtaining genotype information, SCAP mRNA, SCAP protein levels, SCAP activity, the individual's weight and/or blood glucose and/or cholesterol and/or TG, and then comparing such obtained values to one or more baseline values or previously obtained values to assess the effectiveness of contacting or administering.

In any of the embodiments above, the methods include administering the RNAi oligonucleotide or pharmaceutical composition simultaneously, separately, or sequentially with a second composition or a second therapeutic agent. In some embodiments, the second composition or a second therapeutic agent is a SCAP antibody or fragment thereof, a lipid-lowering agent, an anti-diabetic agent or anti-obesity agent. In some embodiments, the second composition or second therapeutic agent is administered with a frequency same as the RNAi oligonucleotide (i.e., every other day, twice a week, or even weekly). In other embodiments, the second composition or second therapeutic agent is administered with a frequency distinct from the RNAi oligonucleotide. Likewise, in other embodiments, the second composition or second therapeutic agent is administered via the same route as the RNAi oligonucleotide (e.g., SQ). In still other embodiments, the second composition or second therapeutic agent is administered via a route that differs from the RNAi oligonucleotide).

In other aspects, uses are described for the RNAi oligonucleotides herein for treating a disease, disorder, or condition associated with SCAP activity, which optionally are administered simultaneously, separately, or sequentially (i.e., in combination) with a second composition or second therapeutic agent.

In other aspects, uses are described for the RNAi oligonucleotides herein in manufacturing a medicament for treating a disease, disorder, or condition associated with SCAP activity, where the medicament optionally further includes a second composition or second therapeutic agent.

In other aspects, kits are described that include at least one oligonucleotide herein, an optional pharmaceutically acceptable carrier, and a package insert having instructions for administering the same to an individual having a disease, disorder, or condition associated with SCAP activity.

An advantage of the oligonucleotides and compositions herein is that suppressed SCAP activity exerts a beneficial effect on the entire spectrum of NAFLD, NASH, dyslipidemia and/or ASCVD.

BRIEF DESCRIPTION OF THE DRAWINGS

The advantages, effects, features, and objects other than those set forth above will become more readily apparent when consideration is given to the detailed description below. Such detailed description refers to the following drawing(s), where:

FIG. 1 discloses a schematic depicting the structure and chemical modification pattern for a generic GalNAc-conjugated SCAP oligonucleotides (modification pattern M1).

DETAILED DESCRIPTION

Overview

NAFLD and NASH are serious public health burdens as they are chronic liver disorders that begin with hepatic TG accumulation (steatosis) and progress to hepatic inflammation and fibrosis, cirrhosis and even liver cancer. SCAP is a transcription regulator that has been shown to be associated with NAFLD and NASH. Here, targeted silencing of SCAP mRNA via RNAi can prevent processing of active SREBP and downstream transcriptional changes in regulating de novo lipogenesis and TG accumulation within the liver.

RNAi is a process of introducing exogeneous RNA into a cell leading to specific degradation of the mRNA encoding the targeted protein with a resultant decrease in target gene expression.

In humans, SCAP is 1279 amino acids in length with a predicted molecular weight of 140 kD. Exemplary nucleic acid sequences for SCAP can be found in NCBI Ref. Seq. No. NM_012235 (isoform 1) and NM_001320044 (isoform 2) (human); NM_001001144 and NM_001103162 (mouse); NM_001100966 (rat); and XM_001100342 (primate). Other exemplary nucleic acid sequences for SCAP include NCBI Ref. Seqs Nos. XM_017005918 (human variant X1), XM_011533501 (human variant X2), XM_005264967 (human variant X3), XM_005264968 (human variant X4), XM_011533502 (human variant X5), XM_005264971 (human variant X6), XM_017005921 (human variant X7), XM_006512083 (mouse variant X1), XM_006512084 (mouse variant X2), XM_006512085 (mouse variant X3), XM_006243922 (rat variant X1), XM_017595596 (rat variant X2), XM_006243923 (rat variant X3), XM_006243924 (rat variant X5), XM_006243925 (rat variant X5), XM_017595597 (rat variant X6), XM_005546961 (primate variant X1), XM_015445807 (primate variant X2), XM_005546962 (primate variant X3), XM_005546963 (primate variant X4), and XM_015445808 (primate variant X5). One of skill in the art, however, understands that additional examples of SCAP mRNA sequences are readily available using publicly available databases such as, for example, GenBank and UniProt.

Abbreviations and Definitions

Unless defined otherwise, all technical and scientific terms used herein have the same meaning as commonly understood by one of skill in the art to which the disclosure pertains. Although any methods and materials similar to or equivalent to those described herein can be used in the practice or testing of the RNAi oligonucleotides herein, pharmaceutical compositions including the same and methods of making and using such RNAi oligonucleotides, the preferred methods and materials are described herein.

Moreover, reference to an element by the indefinite article "a" or "an" does not exclude the possibility that more than one element is present, unless the context clearly requires that there be one and only one element. The indefinite article "a" or "an" thus usually means "at least one."

Furthermore, use of "including," as well as other forms, such as "include," "includes" and "included" is not limiting.

Certain definitions used herein are defined as follows:

As used herein, "about" means within a statistically meaningful range of a value or values such as, for example, a stated concentration, length, molecular weight, pH, sequence similarity, time frame, temperature, volume, etc. Such a value or range can be within an order of magnitude typically within 20%, more typically within 10%, and even more typically within 5% of a given value or range. The allowable variation encompassed by "about" will depend upon the particular system under study, and can be readily appreciated by one of skill in the art.

As used herein, "administer," "administering," "administration" and the like refers to providing a substance (e.g., an oligonucleotide herein or a composition herein) to an individual in a manner that is pharmacologically useful (e.g., to treat a disease, disorder, or condition in the individual).

As used herein, "antisense strand" means an oligonucleotide herein that is complimentary to a region of a target sequence. Likewise, and as used herein, "sense strand" means an oligonucleotide herein that is complimentary to a region of an antisense strand.

As used herein, "asialoglycoprotein receptor" or "ASGPR" means a bipartite C-type lectin formed by a major 48 kDa subunit (ASGPR-1) and minor 40 kDa subunit (ASGPR-2). ASGPR is primarily expressed on the sinusoidal surface of hepatocyte cells and has a major role in binding, internalizing and subsequent clearing of circulating glycoproteins that contain terminal galactose or GalNAc residues (asialoglycoproteins).

As used herein, "attenuate," "attenuating," "attenuation" and the like refers to reducing or effectively halting. As a non-limiting example, one or more of the treatments herein may reduce or effectively halt the onset or progression of AH, ALD, CCA, cirrhosis, hepatic fibrosis, hepatic inflammation, HCC, liver steatosis, NAFLD, NASH and PSC, as well as related diseases, disorders, and conditions in an individual such as, for example, hypercholesterolemia, hyperlipidemia, hypertriglyceridemia, ASCVD, diabetes and/or obesity. This attenuation may be exemplified by, for example, a decrease in one or more aspects (e.g., symptoms, tissue characteristics, and cellular, inflammatory, or immunological activity, etc.) of AH, ALD, CCA, cirrhosis, hepatic fibrosis, hepatic inflammation, HCC, liver steatosis, NAFLD, NASH and PSC, as well as related diseases, disorders, and conditions in an individual such as, for example, hypercholesterolemia, hyperlipidemia, hypertriglyceridemia, ASCVD, diabetes and/or obesity; no detectable progression (worsening) of one or more aspects of AH, ALD, CCA, cirrhosis, hepatic fibrosis, hepatic inflammation, HCC, liver steatosis, NAFLD, NASH and PSC, as well as related diseases, disorders, and conditions in an individual such as, for example hypercholesterolemia, hyperlipidemia, hypertriglyceridemia, ASCVD, diabetes and/or obesity; or no detectable aspects of AH, ALD, CCA, cirrhosis, hepatic fibrosis, hepatic inflammation, HCC, liver steatosis, NAFLD, NASH and PSC, as well as related diseases, disorders, and conditions in an individual such as, for example, hypercholesterolemia, hyperlipidemia, hypertriglyceridemia, ASCVD, diabetes and/or obesity in an individual when they might otherwise be expected.

As used herein, "complementary" means a structural relationship between two nucleotides (e.g., on two opposing nucleic acids or on opposing regions of a single nucleic acid strand) that permits the two nucleotides to form base pairs with one another. For example, a purine nucleotide of one nucleic acid that is complementary to a pyrimidine nucleotide of an opposing nucleic acid may base pair together by forming hydrogen bonds with one another. Complementary nucleotides can base pair in the Watson-Crick manner or in any other manner that allows for the formation of stable duplexes. Likewise, two nucleic acids may have regions of multiple nucleotides that are complementary with each other to form regions of complementarity, as described herein.

As used herein, "contact," "contacting" and the like means directly or indirectly introducing or delivering an oligonucleotide such as a RNAi oligonucleotide into, for example, a cell by facilitating or effecting uptake or absorption into the cell.

As used herein, "deoxyribonucleotide" means a nucleotide having a hydrogen in place of a hydroxyl at the 2' position of its pentose sugar when compared with a ribonucleotide. A modified deoxyribonucleotide has one or more modifications or substitutions of atoms other than at the 2' position, including modifications or substitutions in or of the nucleobase, sugar, or phosphate group.

As used herein, "double-stranded oligonucleotide" or "ds oligonucleotide" means an oligonucleotide that is substantially in a duplex form. The complementary base-pairing of duplex region(s) of a ds oligonucleotide can be formed between antiparallel sequences of nucleotides of covalently separate nucleic acid strands. Likewise, complementary base-pairing of duplex region(s) of a ds oligonucleotide can be formed between antiparallel sequences of nucleotides of nucleic acid strands that are covalently linked. Moreover, complementary base-pairing of duplex region(s) of a ds oligonucleotide can be formed from single nucleic acid strand that is folded (e.g., via a hairpin) to provide complementary antiparallel sequences of nucleotides that base pair together. A ds oligonucleotide can include two covalently separate nucleic acid strands that are fully duplexed with one another. However, a ds oligonucleotide can include two covalently separate nucleic acid strands that are partially duplexed (e.g., having overhangs at one or both ends). A ds oligonucleotide can include an antiparallel sequence of nucleotides that are partially complementary, and thus, may have one or more mismatches, which may include internal mismatches or end mismatches.

As used herein, "duplex," in reference to nucleic acids (e.g., oligonucleotides), means a structure formed through complementary base pairing of two antiparallel sequences of nucleotides.

As used herein, "excipient" means a non-therapeutic agent that may be included in a composition herein, for example, to provide or contribute to a desired consistency or stabilizing effect.

As used herein, "hepatocyte" or "hepatocytes" means cells of the parenchymal tissues of the liver. These cells make up about 70%-85% of the liver's mass and manufacture serum albumin, fibrinogen (FBN) and the prothrombin group of clotting factors (except for Factors 3 and 4). Markers for hepatocyte lineage cells include, but are not limited to, transthyretin (Ttr), glutamine synthetase (Glu1), hepatocyte nuclear factor 1a (Hnf1a) and hepatocyte nuclear factor 4a (Hnf4a). Markers for mature hepatocytes may include, but are not limited to, cytochrome P450 (Cyp3a11), fumarylacetoacetate hydrolase (Fah), glucose 6-phosphate (G6p), albumin (Alb) and OC2-2F8. See, e.g., Huch et al. (2013) *Nature* 494:247-250.

As used herein, a "hepatotoxic agent" means a chemical compound, virus or other substance that is itself toxic to the liver or can be processed to form a metabolite that is toxic to the liver. Hepatotoxic agents may include, but are not limited to, carbon tetrachloride ($CCl_4$), acetaminophen (paracetamol), vinyl chloride, arsenic, chloroform, and non-steroidal anti-inflammatory drugs (such as aspirin and phenylbutazone).

As used herein, "individual" means any mammal, including cats, dogs, mice, rats, and primates, especially humans. Moreover, "subject" or "patient" may be used interchangeably with "individual."

As used herein, "labile linker" means a linker that can be cleaved (e.g., by acidic pH). Likewise, "fairly stable linker" means a linker that cannot be cleaved.

As used herein, "liver inflammation" or "hepatitis" means a physical condition in which the liver becomes swollen, dysfunctional and/or painful, especially because of injury or infection, as may be caused by exposure to a hepatotoxic agent. Symptoms may include jaundice, fatigue, weakness, nausea, vomiting, appetite reduction, and weight loss. Liver inflammation, if left untreated, may progress to fibrosis, cirrhosis, liver failure or liver cancer.

As used herein, "liver fibrosis," "hepatic fibrosis" or "fibrosis of the liver" refers to an excessive accumulation in the liver of extracellular matrix proteins, which could include collagens (I, III, and IV), FBN, undulin, elastin, laminin, hyaluronan, and proteoglycans resulting from inflammation and liver cell death. Liver fibrosis, if left untreated, may progress to cirrhosis, liver failure, or liver cancer.

As used herein, "loop" means an unpaired region of a nucleic acid (e.g., oligonucleotide) that is flanked by two antiparallel regions of the nucleic acid that are sufficiently complementary to one another, such that under appropriate hybridization conditions (e.g., in a phosphate buffer, in a cells), the two antiparallel regions, which flank the unpaired region, hybridize to form a duplex (referred to as a "stem").

As used herein, "modified internucleotide linkage" means an internucleotide linkage having one or more chemical modifications when compared with a reference internucleotide linkage having a phosphodiester bond. A modified nucleotide can be a non-naturally occurring linkage. Typically, a modified internucleotide linkage confers one or more desirable properties to a nucleic acid in which the modified internucleotide linkage is present. For example, a modified nucleotide may improve thermal stability, resistance to degradation, nuclease resistance, solubility, bioavailability, bioactivity, reduced immunogenicity, etc.

As used herein, "modified nucleotide" refers to a nucleotide having one or more chemical modifications when compared with a corresponding reference nucleotide selected from: adenine ribonucleotide, guanine ribonucleotide, cytosine ribonucleotide, uracil ribonucleotide, adenine deoxyribonucleotide, guanine deoxyribonucleotide, cytosine deoxyribonucleotide and thymidine deoxyribonucleotide. A modified nucleotide can be a non-naturally occurring nucleotide. A modified nucleotide can have, for example, one or more chemical modifications in its sugar, nucleobase and/or phosphate group. Additionally or alternatively, a modified nucleotide can have one or more chemical moieties conjugated to a corresponding reference nucleotide. Typically, a modified nucleotide confers one or more desirable properties to a nucleic acid in which the modified nucleotide is present. For example, a modified nucleotide may improve thermal stability, resistance to degradation, nuclease resistance, solubility, bioavailability, bioactivity, reduced immunogenicity, etc.

As used herein, "nicked tetraloop structure" mean a structure of a RNAi oligonucleotide that is characterized by separate sense and antisense strands, in which the sense strand has a region of complementarity with the antisense strand, and in which at least one of the strands, generally the sense strand, has a tetraloop configured to stabilize an adjacent stem region formed within the at least one strand.

As used herein, "nucleoside" means a nucleobase-sugar combination, where the nucleobase portion is normally a heterocyclic base. The two most common classes of such heterocyclic bases are purines and pyrimidines. The sugar is normally a pentose sugar such as a ribose or a deoxyribose (e.g., 2'-deoxyribose).

As used herein, "nucleotide" means an organic molecule having a nucleoside (a nucleobase such as, for example, adenine, cytosine, guanine, thymine, or uracil; and a pentose sugar such as, e.g., ribose or 2'-deoxyribose) and a phosphate group, which can serve as a monomeric unit of nucleic acid polymers such as deoxyribonucleic acid (DNA) and ribonucleic acid (RNA).

As used herein, "oligonucleotide" means a short nucleic acid molecule (e.g., less than about 100 nucleotides in length). An oligonucleotide may be single-stranded (ss) or ds. An oligonucleotide may or may not have duplex regions. As a set of non-limiting examples, an oligonucleotide may be, but is not limited to, a small interfering RNA (siRNA), microRNA (miRNA), short hairpin RNA (shRNA), Dicer substrate interfering RNA (DsiRNA), antisense oligonucleotide (ASO), short siRNA or ss siRNA. Typically, a ds oligonucleotide is a RNAi oligonucleotide.

As used herein, "overhang" means a terminal non-base pairing nucleotide(s) resulting from one strand or region extending beyond the terminus of a complementary strand with which the one strand or region forms a duplex. An overhang may include one or more unpaired nucleotides extending from a duplex region at the 5' terminus or 3' terminus of a ds oligonucleotide. The overhang can be a 3' or 5' overhang on the antisense strand or sense strand of a ds oligonucleotide.

As used herein, "phosphate analog" means a chemical moiety that mimics the electrostatic and/or steric properties of a phosphate group. In some embodiments, a phosphate analog is positioned at the 5' terminal nucleotide of an oligonucleotide in place of a 5'-phosphate, which is often susceptible to enzymatic removal. A 5' phosphate analog can include a phosphatase-resistant linkage. Examples of phosphate analogs include, but are not limited to, 5' phosphonates, such as 5' methylenephosphonate (5'-MP) and 5'-(E)-vinylphosphonate (5'-VP). An oligonucleotide can have a phosphate analog at a 4'-carbon position of the sugar (referred to as a "4'-phosphate analog") at a 5'-terminal nucleotide. An example of a 4'-phosphate analog is oxymethylphosphonate, in which the oxygen atom of the oxymethyl group is bound to the sugar moiety (e.g., at its 4'-carbon) or analog thereof. See, e.g., Intl. Patent Application Publication No. WO 2018/045317. Other modifications have been developed for the 5' end of oligonucleotides (see, e.g., Intl. Patent Application No. WO 2011/133871; U.S. Pat. No. 8,927,513; and Prakash et al. (2015) *Nucleic Acids Res.* 43:2993-3011).

As used herein, or "SCAP-associated condition," "SCAP-associated disease" or "SCAP-associated disorder" means such a disease, disorder, or condition having increased SCAP activity and/or the presence of, for example, a SCAP polymorphism. Exemplary SCAP-associated conditions, diseases or disorders include, but are not limited to, AH, ALD, CCA, cirrhosis, hepatic fibrosis, hepatic inflammation, HCC, liver steatosis, NAFLD, NASH and PSC, as well as related diseases, disorders, and conditions in an individual such as, for example hypercholesterolemia, hyperlipidemia, hypertriglyceridemia, ASCVD, diabetes and/or obesity.

As used herein, "reduced expression" or "reduced activity," and with respect to a gene (e.g., SCAP), means a decrease in the amount or level of RNA transcript (e.g., SCAP mRNA) or protein (e.g., SCAP protein) encoded by the gene and/or a decrease in the amount or level of activity of the gene or protein in a cell, a population of cells, a sample or a subject, when compared to an appropriate reference (e.g., a reference cell, population of cells, sample or individual). For example, the act of contacting a cell with an oligonucleotide herein (e.g., an oligonucleotide having an antisense strand having a nucleotide sequence that is complementary to a nucleotide sequence including SCAP mRNA) may result in a decrease in the amount or level of mRNA, protein and/or activity (e.g., via degradation of SCAP mRNA by the RNAi pathway) when compared to a cell that is not treated with the ds oligonucleotide. Similarly, and as used herein, "reducing expression" or "reducing activity" means an act that results in reduced expression of a gene (e.g., SCAP). Specifically, and as used herein, "reduction of SCAP expression" or "reduction of SCAP activity" means a decrease in the amount or level of SCAP activity such as, for example, SCAP mRNA and/or SCAP protein and/or SCAP activity in a cell, a population of cells, a sample or a subject when compared to an appropriate reference (e.g., a reference cell, population of cells, tissue or individual).

As used herein, "region of complementarity" means a sequence of nucleotides of a nucleic acid (e.g., a ds oligonucleotide) that is sufficiently complementary to an antiparallel sequence of nucleotides to permit hybridization between the two sequences of nucleotides under appropriate hybridization conditions (e.g., in a phosphate buffer, in a cell, etc.). An oligonucleotide herein includes a targeting sequence having a region of complementary to a mRNA target sequence.

As used herein, "ribonucleotide" means a nucleotide having a ribose as its pentose sugar, which contains a hydroxyl group at its 2' position. A modified ribonucleotide is a ribonucleotide having one or more modifications or substitutions of atoms other than at the 2' position, including modifications or substitutions in or of the nucleobase, sugar, or phosphate group.

As used herein, "iRNA," "iRNA agent," "RNAi," "RNAi agent" and "RNA interference agent" means an agent such as, for example, a RNAi oligonucleotide, which contains RNA and which mediates the targeted cleavage of an RNA transcript via a RNA-induced silencing complex (RISC) pathway to direct sequence-specific degradation of mRNA via RNA interference. The agent thus modulates, inhibits or reduces gene expression in a cell.

As used herein, "RNAi oligonucleotide" refers to either (a) a ds oligonucleotide having a sense strand and antisense strand, in which the antisense strand or part of the antisense strand is used by the Argonaute 2 (Ago2) endonuclease in the cleavage of a target mRNA or (b) a ss oligonucleotide having a single antisense strand, where that antisense strand (or part of that antisense strand) is used by the Ago2 endonuclease in the cleavage of a target mRNA.

As used herein, "strand" refers to a single, contiguous sequence of nucleotides linked together through internucleotide linkages (e.g., phosphodiester linkages or phosphorothioate linkages). A strand can have two free ends (e.g., a 5' end and a 3' end).

As used herein, "synthetic" refers to a nucleic acid or other molecule that is artificially synthesized (e.g., using a machine such as, for example, a solid-state nucleic acid synthesizer) or that is otherwise not derived from a natural source (e.g., a cell or organism) that normally produces the nucleic acid or other molecule.

As used herein, "targeting ligand" means a molecule (e.g., an amino sugar, carbohydrate, cholesterol, lipid, or polypeptide) that selectively binds to a cognate molecule (e.g., a receptor) of a tissue or cell of interest and that is conjugatable to another substance for targeting another substance to the tissue or cell of interest. For example, a targeting ligand may be conjugated to an oligonucleotide herein for purposes of targeting the oligonucleotide to a specific tissue or cell of interest. A targeting ligand can selectively bind to a cell surface receptor. Accordingly, a targeting ligand, when conjugated to an oligonucleotide, facilitates delivery of the oligonucleotide into a particular cell through selective binding to a receptor expressed on the surface of the cell and endosomal internalization by the cell of the complex comprising the oligonucleotide, targeting ligand and receptor. Moreover, a targeting ligand can be conjugated to an oligonucleotide via a linker that is cleaved following or during cellular internalization such that the oligonucleotide is released from the targeting ligand in the cell.

As used herein, "tetraloop" or "teraL" means a loop that increases stability of an adjacent duplex formed by hybridization of flanking sequences of nucleotides. The increase in stability is detectable as an increase in melting temperature ($T_m$) of an adjacent stem duplex that is higher than the $T_m$ of the adjacent stem duplex expected, on average, from a set of loops of comparable length consisting of randomly selected sequences of nucleotides. For example, a tetraL can confer a $T_m$ of at least about 50° C., at least about 55° C., at least about 56° C., at least about 58° C., at least about 60° C., at least about 65° C., or at least about 75° C. in 10 mM $NaHPO_4$ to a hairpin comprising a duplex of at least 2 base pairs (bp) in length. A tetraL also may stabilize a bp in an adjacent stem duplex by stacking interactions. Additionally, interactions among the nucleotides in a tetraloop include, but are not limited to, non-Watson-Crick base pairing, stacking interactions, hydrogen bonding, and contact interactions (Cheong et al. (1990) Nature 346:680-82; Heus & Pardi (1991) Science 253:191-94). Here, a tetraL can include or can have about 3 to about 6 nucleotides, and typically is about 4 to about 5 nucleotides. A tetraL therefore can have 3, 4, 5, or 6 nucleotides, which may or may not be modified (e.g., which may or may not be conjugated to a targeting moiety), especially 4 nucleotides. Any nucleotide may be used in the tetraL, and standard IUPAC-IUB symbols for such nucleotides may be used as described in Cornish-Bowden (1985) Nucleic Acids Res. 13:3021-30. For example, the letter "N" may be used to mean that any base may be in that position, the letter "R" may be used to show that A (adenine) or G (guanine) may be in that position, and "B" may be used to show that C (cytosine), G (guanine), or T (thymine) may be in that position. Examples of tetraL include the UNCG family of tetraloops (e.g., UUCG), the GNRA family of tetraloops (e.g., GAAA) and the CUUG tetraloop (Woese et al. (1990) Proc. Natl. Acad. Sci. USA 87:8467-71; Antao et al. (1991) Nucleic Acids Res. 19:5901-05). Examples of DNA tetraloops include the d(GNNA) family of tetraloops (e.g., d(GTTA)), the d(GNRA) family of tetraloops, the d(GNAB) family of tetraloops, the d(CNNG) family of tetraloops, and the d(TNCG) family of tetraloops (e.g., d(TTCG)). See, e.g., Nakano et al. (2002) Biochem. 41:4281-92; and Shinji et al. (2000) Nippon Kagakkai Koen Yokoshu 78:731. Here, the tetraL can be within a nicked tetraL structure.

As used herein, "treat" or "treating" means an act of providing care to an individual in need thereof, for example, by administering a therapeutic agent (e.g., an oligonucleotide herein) to the individual for purposes of improving the health and/or well-being of the individual with respect to an existing a disease, disorder, or condition, or to prevent or decrease the likelihood of the occurrence of a disease, disorder, or condition. Treating also can involve reducing the frequency or severity of at least one sign, symptom or contributing factor of a disease, disorder, or condition experienced by the individual.

Compositions

Oligonucleotide Inhibitors of SCAP Activity

I. SCAP Target Sequences: The oligonucleotides herein (e.g., an antisense strand of a ds oligonucleotide such as a RNAi oligonucleotide) are targeted to a target sequence within SCAP mRNA. For example, an oligonucleotide, or a portion, fragment, or strand thereof binds or anneals to a target sequence within a SCAP mRNA, thereby inhibiting SCAP activity. In some embodiments, the oligonucleotide is targeted to a SCAP target sequence for inhibiting SCAP activity in vivo. In some embodiments, the amount or extent of inhibition of SCAP activity by an oligonucleotide targeted to a SCAP target sequence correlates with the potency of the oligonucleotide. In some embodiments, the amount or extent of inhibition of SCAP activity by an oligonucleotide targeted to a SCAP target sequence correlates with the amount or extent of therapeutic benefit in an individual having or suspected of having a disease, disorder, or condition associated with SCAP activity treated with the oligonucleotide.

Through examining and analyzing the nucleotide sequence of SCAP mRNAs, including mRNAs of multiple different species (e.g., human, mouse and/or monkey; see, e.g., Example 2) and because of in vitro and in vivo testing (see, e.g., Examples 3 and 4), it is shown herein that certain nucleotide sequences of SCAP mRNA are more amenable than others to oligonucleotide-based inhibition of SCAP activity and are thus useful as target sequences for the oligonucleotides herein. In some embodiments, a sense strand of an oligonucleotide herein (e.g., a ds oligonucleotide such as a RNAi oligonucleotide; e.g., in Table 3) includes a SCAP target sequence. In some instances, a portion or region of the sense strand of RNAi oligonucleotide herein (e.g., in Table 3) includes a SCAP target sequence. In some embodiments, a SCAP target sequence comprises, or consists of, a sequence of any one of SEQ ID NOs: 777 to 783 or any one of the odd numbers of SEQ ID NOs: 785 to 1168 (especially any one of SEQ ID NOs: 915, 923, 997, 1049, 1097, 1109, and 1137).

II. SCAP mRNA Targeting Sequences: In some embodiments, the oligonucleotide herein (e.g., an antisense strand of a ds oligonucleotide such as a RNAi oligonucleotide) has a region of complementarity to SCAP mRNA (e.g., within a target sequence of SCAP mRNA) for targeting SCAP mRNA in cells and inhibiting SCAP activity. In some embodiments, the oligonucleotide comprises a SCAP targeting sequence (e.g., an antisense strand of a ds oligonucleotide) having a region of complementarity that binds or anneals to a SCAP mRNA target sequence by complementary (Watson-Crick) base pairing. The targeting sequence or region of complementarity is of a suitable length and base content to enable binding or annealing of the oligonucleotide (or a strand thereof) to a SCAP mRNA for inhibiting its expression. In some embodiments, the targeting sequence or region of complementarity is at least about 12, at least about 13, at least about 14, at least about 15, at least about 16, at least about 17, at least about 18, at least about 19, at least about 20, at least about 21, at least about 22, at least about 23, at least about 24, at least about 25, at least about 26, at least about 27, at least about 28, at least about 29, or at least about 30 nucleotides in length. Alternatively, the targeting sequence or region of complementarity is about 12 to about 30 (e.g., 12 to 30, 12 to 22, 15 to 25, 17 to 21, 18 to 27, 19 to 27, or 15 to 30) nucleotides in length. Alternatively, the targeting sequence or region of complementarity is about 12, 13, 14, 15, 16, 17, 18, 19, 20, 21, 22, 23, 24, 25, 26, 27, 28, 29, or 30 nucleotides in length. In certain embodiments, the targeting sequence or region of complementarity is 18 nucleotides in length. In certain embodiments, the targeting sequence or region of complementarity is 19 nucleotides in length. In certain embodiments, the targeting sequence or region of complementarity is 20 nucleotides in length. In certain embodiments, the targeting sequence or region of complementarity is 21 nucleotides in length. In certain embodiments, the targeting sequence or region of complementarity is 22 nucleotides in length. In certain embodiments, the targeting sequence or region of complementarity is 23 nucleotides in length. In certain embodiments, the targeting sequence or region of complementarity is 24 nucleotides in length.

In some embodiments, the oligonucleotide herein comprises a targeting sequence or a region of complementarity (e.g., an antisense strand of a ds oligonucleotide) that is fully complementary to a SCAP mRNA targeting sequence. In some embodiments, the targeting sequence or region of complementarity is partially complementary to a SCAP mRNA targeting sequence. In some embodiments, the oligonucleotide comprises a targeting sequence or region of complementarity that is fully complementary to a sequence of any one of SEQ ID NOs: 777 to 783. In some embodiments, the oligonucleotide comprises a targeting sequence or region of complementarity that is partially complementary to a sequence of any one of SEQ ID NOs: 777 to 783.

Alternatively, in some embodiments, the oligonucleotide herein comprises a targeting sequence or region of complementarity that is complementary to a contiguous sequence of nucleotides comprising a SCAP mRNA, where the contiguous sequence of nucleotides is about 12 to about 30 nucleotides in length (e.g., 12 to 30, 12 to 28, 12 to 26, 12 to 24, 12 to 20, 12 to 18, 12 to 16, 14 to 22, 16 to 20, 18 to 20, or 18 to 19 nucleotides in length). In some embodiments, the oligonucleotide comprises a targeting sequence or region of complementarity that is complementary to a contiguous sequence of nucleotides comprising a SCAP mRNA, where the contiguous sequence of nucleotides is 10, 11, 12, 13, 14, 15, 16, 17, 18, 19, or 20 nucleotides in length. In some embodiments, the oligonucleotide comprises a targeting sequence or region of complementarity that is complementary to a contiguous sequence of nucleotides comprising a SCAP mRNA, where the contiguous sequence of nucleotides is 19 nucleotides in length. In some embodiments, the oligonucleotides comprise a targeting sequence or region of complementarity that is complementary to a contiguous sequence of nucleotides comprising a SCAP mRNA, where the contiguous sequence of nucleotides is 20 nucleotides in length. In other embodiments, the oligonucleotides comprise a targeting sequence or a region of complementarity that is complementary to a contiguous sequence of nucleotides of any one of SEQ ID NOs: 777 to 783, optionally where the contiguous sequence of nucleotides is 19 nucleotides in length.

With regard to the targeting sequence or region of complementarity of the oligonucleotides herein, it is complementary to contiguous nucleotides of a sequence as set forth in any one of SEQ ID NOs: 777 to 783 and spans the entire length of an antisense strand. In some embodiments, the region of complementarity of the oligonucleotide is complementary to contiguous nucleotides of a sequence as set forth in any one of SEQ ID NOs: 777 to 783 and spans a portion of the entire length of an antisense strand. In some additional embodiments, the oligonucleotide includes a region of complementarity (e.g., on an antisense strand of a ds oligonucleotide) that is at least partially (e.g., fully) complementary to a contiguous stretch of nucleotides spanning nucleotides 1-20, 1-19, 1-18, etc. of a sequence as set forth in any one of SEQ ID NOs: 777 to 783.

Alternatively, the oligonucleotide comprises a targeting sequence or region of complementarity having one or more base pair (bp) mismatches with the corresponding SCAP mRNA target sequence. In some embodiments, the targeting sequence or region of complementarity is up to about 1, up to about 2, up to about 3, up to about 4, up to about 5, etc. mismatches with the corresponding SCAP target sequence, provided that the ability of the targeting sequence or region of complementarity to bind or anneal to a SCAP mRNA under appropriate hybridization conditions and/or the ability of the oligonucleotide to reduce or inhibit SCAP activity is maintained. Stated differently, the targeting sequence or region of complementarity is no more than 1, no more than 2, no more than 3, no more than 4, or no more than 5 mismatches with the corresponding SCAP target sequence provided that the ability of the targeting sequence or region of complementarity to bind or anneal to a SCAP mRNA under appropriate hybridization conditions and/or the ability of the oligonucleotide to reduce or inhibit SCAP activity is maintained. In some embodiments, the oligonucleotide comprises a targeting sequence or region of complementarity having 1 mismatch with the corresponding target sequence. In some embodiments, the oligonucleotide comprises a targeting sequence or region of complementarity having 2 mismatches with the corresponding target sequence. In some embodiments, the oligonucleotide comprises a targeting sequence or a region of complementarity having 3 mismatches with the corresponding target sequence. In some embodiments, the oligonucleotide comprises a targeting sequence or region of complementarity having 4 mismatches with the corresponding target sequence. In some embodiments, the oligonucleotide comprises a targeting sequence or region of complementarity having 5 mismatches with the corresponding target sequence. In other embodiments, the oligonucleotide comprises a targeting sequence or a region of complementarity more than one mismatch (e.g., 2, 3, 4, 5 or more mismatches) with the corresponding target sequence, where at least 2 (e.g., all) of the mismatches are positioned consecutively (e.g., 2, 3, 4, 5 or more mismatches in a row), or where the mismatches are interspersed in any position throughout the targeting sequence or region of complementarity. In other embodiments, the oligonucleotide comprises a targeting sequence or region of complementarity more than one mismatch (e.g., 2, 3, 4, 5 or more mismatches) with the corresponding target sequence, where at least 2 (e.g., all) of the mismatches are positioned consecutively (e.g., 2, 3, 4, 5 or more mismatches in a row), or where at least one or more non-mismatched bp is located between the mismatches, or a combination thereof.

III. Types of Oligonucleotides: A variety of oligonucleotide types and/or structures are useful for targeting SCAP mRNA including, but not limited to, RNAi oligonucleotides, ASOs, miRNAs, etc. Any of the oligonucleotide types described herein or elsewhere are contemplated for use as a framework to incorporate a targeting sequence herein for the purposes of inhibiting SCAP activity. In some embodiments, the oligonucleotide herein inhibits SCAP activity by engaging with RNAi pathways upstream or downstream of Dicer involvement. For example, RNAi oligonucleotides have been developed with each strand having sizes of about 19-25 nucleotides with at least one 3' overhang of 1 to 5 nucleotides (see, e.g., U.S. Pat. No. 8,372,968). Longer oligonucleotides also have been developed that are processed by Dicer to generate active RNAi products (see, e.g., U.S. Pat. No. 8,883,996). Further work produced extended ds oligonucleotides where at least one end of at least one strand is extended beyond a duplex targeting region, including structures where one of the strands includes a thermodynamically stabilizing tetraL (see, e.g., U.S. Pat. Nos. 8,513,207 and 8,927,705, as well as Intl. Patent Application Publication No. WO 2010/033225). Such structures include ss extensions (on one or both sides of the molecule) as well as ds extensions.

The oligonucleotides herein engage with the RNAi pathway downstream of the involvement of Dicer (e.g., Dicer cleavage). In some embodiments, the oligonucleotide has an overhang (e.g., of 1, 2, or 3 nucleotides in length) in the 3' end of the sense strand. In some embodiments, the oligonucleotide (e.g., siRNA) includes a 21-nucleotide antisense strand that is antisense to a target mRNA (e.g., SCAP mRNA) and a complementary sense strand, in which both strands anneal to form a 19-bp duplex and 2 nucleotide overhangs at either or both 3' ends. Longer oligonucleotide designs also are contemplated, including oligonucleotides having an antisense strand of 23 nucleotides and a sense strand of 21 nucleotides, where there is a blunt end on the right side of the molecule (3' end of sense strand/5' end of antisense strand) and a two nucleotide 3' antisense strand overhang on the left side of the molecule (5' end of the sense strand/3' end of the antisense strand). In such molecules, there is a 21 bp duplex region. See, e.g., U.S. Pat. Nos. 9,012,138; 9,012,621 and 9,193,753.

The oligonucleotide herein comprises sense and antisense strands that are both in the range of about 17 to about 26 (e.g., 17 to 26, 20 to 25, or 21-23) nucleotides in length. In some embodiments, the oligonucleotide comprises a sense and antisense strand that are both in the range of about 19 to about 22 nucleotides in length. In some embodiments, the sense and antisense strands are of equal length. In some embodiments, the oligonucleotide comprises sense and antisense strands, such that there is a 3' overhang on either the sense strand or the antisense strand, or both the sense and antisense strand. In some embodiments, for an oligonucleotide having sense and antisense strands that are both in the range of about 21 to about 23 nucleotides in length, a 3' overhang on the sense, antisense or both sense and antisense strands is 1 or 2 nucleotides in length. In some embodiments, the oligonucleotide comprises an antisense strand of 22 nucleotides and a sense strand of 20 nucleotides, where there is a blunt end on the right side of the molecule (3' end of sense strand/5' end of antisense strand) and a 2 nucleotide 3' antisense strand overhang on the left side of the molecule (5' end of the sense strand/3' end of the antisense strand). In such molecules, there is a 20-bp duplex region.

Other oligonucleotide designs for use herein include: 16-mer siRNAs (see, e.g., "Nucleic Acids in Chemistry & Biology," Blackburn (ed.), Royal Society of Chemistry, 2006), shRNAs (e.g., having 19 bp or shorter stems; see, e.g., Moore et al. (2010) Methods Mol. Biol. 629:141-58), blunt siRNAs (e.g., of 19 bps in length; see, e.g., Kraynack & Baker (2006) RNA 12:163-76), asymmetrical siRNAs (aiRNA; see, e.g., Sun et al. (2008) Nat. Biotechnol. 26:1379-82), asymmetric shorter-duplex siRNA (see, e.g., Chang et al. (2009) Mol. Ther. 17:725-32), fork siRNAs (see, e.g., Hohjoh (2004) Febs Lett. 557:193-98), ss siRNAs (see, e.g., Elsner (2012) Nat. Biotechnol. 30:1063), dumbbell-shaped circular siRNAs (see, e.g., Abe et al. (2007) J. Am. Chem. Soc. 129:15108-09), and small internally segmented interfering RNA (sisiRNA; see, e.g., Bramsen et al. (2007) Nucleic Acids Res. 35:5886-97). Further non-limiting examples of oligonucleotide structures that may be used herein to reduce or inhibit SCAP activity are miRNA, shRNA, and short siRNA (see, e.g., Hamilton et al. (2002) EMBO J. 21:4671-79; see also, U.S. Pat. No. 7,659,389).

Alternatively, the oligonucleotide herein is ss. Such structures include, but are not limited to, ss RNAi molecules. Recent efforts have demonstrated the activity of ss RNAi molecules (see, e.g., Matsui et al. (2016) Mol. Ther. 24:946-55). In some embodiments, the oligonucleotide is an ASOs. An ASO is a ss oligonucleotide that has a nucleobase sequence that, when written or depicted in the 5' to 3' direction, includes a reverse complement of a targeted segment of a particular nucleic acid and is suitably modified (e.g., as a gapmer) to induce RNaseH-mediated cleavage of its target RNA in cells or (e.g., as a mixmer) so as to inhibit translation of the target mRNA in cells. ASOs for use herein are modified in any suitable manner known in the art including, for example, as shown in U.S. Pat. No. 9,567,587 (including, for example, length, sugar moieties of the nucleobase (pyrimidine, purine), and alterations of the heterocyclic portion of the nucleobase). Further, ASOs have been used for decades to reduce expression of specific target genes (see, e.g., Bennett et al. (2017) Annu. Rev. Pharmacol. 57:81-105).

IV. ds RNAi Oligonucleotides: ds RNAi oligonucleotides for targeting SCAP mRNA and inhibiting SCAP activity (e.g., via the RNAi pathway) comprise a sense strand and an antisense strand. In some embodiments, the sense strand and antisense strand are separate strands and are not covalently linked. In some embodiments, the sense strand and antisense strand are covalently linked.

In some embodiments, the sense strand comprises a first region (R1) and a second region (R2), where R2 comprises a first subregion (S1), a triL or a L, and a second subregion (S2), where triL or L is located between S1 and S2, and where S1 and S2 form a second duplex (D2). D2 has various lengths. In some embodiments, D2 is about 1 to about 6 bp in length. In other embodiments, D2 is 2-6, 3-6, 4-6, 5-6, 1-5, 2-5, 3-5 or 4-5 bp in length. In other embodiments, D2 is 1, 2, 3, 4, 5 or 6 bp in length. In certain embodiments, D2 is 6 bp in length.

In some embodiments, R1 of the sense strand and the antisense strand forms a first duplex (D1). In some embodiments, D1 is at least about 15 (e.g., at least 15, at least 16, at least 17, at least 18, at least 19, at least 20 or at least 21) nucleotides in length. In other embodiments, D1 is about 12 to about 30 nucleotides in length (e.g., 12 to 30, 12 to 27, 15 to 22, 18 to 22, 18 to 25, 18 to 27, 18 to 30 or 21 to 30 nucleotides in length). In other embodiments, D1 is at least 12 nucleotides in length (e.g., at least 12, at least 15, at least 20, at least 25 or at least 30 nucleotides in length). In other embodiments, D1 is 12, 13, 14, 15, 16, 17, 18, 19, 20, 21, 22, 23, 24, 25, 26, 27, 28, 29 or 30 nucleotides in length. In certain embodiments, D1 is 20 nucleotides in length. In some embodiments, D1 does not span the entire length of the sense strand and/or antisense strand. In other embodiments, D1 spans the entire length of either the sense strand or antisense strand or both. In certain embodiments, D1 spans the entire length of both the sense strand and the antisense strand.

In certain embodiments, the disclosure describes RNAi oligonucleotides for reducing or inhibiting SCAP activity that include a sense strand comprising, or alternatively consisting of, a sequence as set forth in Table 3 (e.g., any one of the odd numbers of SEQ ID NOs: 9 to 392), especially SEQ ID NOs: 139, 147, 221, 273, 321, 333, and 361.

In certain embodiments, the disclosure describes RNAi oligonucleotides for reducing or inhibiting SCAP activity that include an antisense strand comprising, or alternatively consisting of, a sequence as set forth in Table 3 (e.g., any one of the even numbers of SEQ ID NOs: 9 to 392), especially SEQ ID NOs: 140, 148, 222, 274, 322, 334, and 362.

In certain other embodiments, the RNAi oligonucleotide includes a sense strand comprising, or alternatively consisting of, a nucleotide sequence of any one of SEQ ID NOs: 139, 147, 221, 273, 321, 333 and 361, and an antisense strand comprising, or alternatively consisting of, a nucleotide sequence of any one of SEQ ID NOs: 140, 148, 222, 274, 322, 334 and 362.

In certain embodiments, the sense strand and the antisense strand of a RNAi oligonucleotide, respectively, are selected from:

(a) SEQ ID NOs: 139 and 140,
(b) SEQ ID NOs: 147 and 148,
(c) SEQ ID NOs: 221 and 222,
(d) SEQ ID NOs: 273 and 274,
(e) SEQ ID NOs: 321 and 322,
(f) SEQ ID NOs: 333 and 334, and
(g) SEQ ID NOs: 361 and 362.

In certain additional embodiments, the RNAi oligonucleotide includes a sense strand comprising, or alternatively consisting of, a nucleotide sequence of SEQ ID NO: 147 or 333, and an antisense strand comprising, or alternatively consisting of, a nucleotide sequence of SEQ ID NO: 148 or 334. Alternatively, the sense strand is SEQ ID NO: 147 and the antisense strand is SEQ ID NO: 148. Alternatively, the sense strand is SEQ ID NO: 333 and the antisense strand is SEQ ID NO: 334.

In some embodiments, the RNAi oligonucleotide includes a sense strand comprising, or alternatively consisting of, a nucleotide sequence as set forth in Table 4 (e.g., any one of the odd numbers of SEQ ID NOs: 393 to 776), especially SEQ ID NOs: 523, 531, 605, 657, 705, 717, and 745.

In certain embodiments, the RNAi oligonucleotide includes an antisense strand comprising, or alternatively consisting of, a nucleotide sequence as set forth in Table 4 (e.g., any one of the even numbers of SEQ ID NOs: 393 to 776), especially SEQ ID NOs: 524, 532, 606, 658, 706, 718, and 746.

In certain other embodiments, the RNAi oligonucleotide includes a sense strand comprising, or alternatively consisting of, a nucleotide sequence of any one of SEQ ID NOs: 523, 531, 605, 657, 705, 717 and 745, and an antisense strand comprising, or alternatively consisting of, a nucleotide sequence of any one of SEQ ID NOs: 524, 532, 606, 658, 706, 718 and 746.

In certain embodiments, the sense strand, and the antisense strand of the RNAi oligonucleotide, respectively, are selected from:

(a') SEQ ID NOs: 523 and 524,
(b') SEQ ID NOs: 531 and 532,
(c') SEQ ID NOs: 605 and 606,
(d') SEQ ID NOs: 657 and 658,
(e') SEQ ID NOs: 705 and 706,
(f') SEQ ID NOs: 717 and 718, and
(g') SEQ ID NOs: 745 and 746.

In certain additional embodiments, the RNAi oligonucleotide includes a sense strand comprising, or alternatively consisting of, a nucleotide sequence of SEQ ID NO: 531 or 717, and an antisense strand comprising, or alternatively consisting of, a nucleotide sequence of SEQ ID NO: 532 or 718. Alternatively, the sense strand is SEQ ID NO: 531 and the antisense strand is SEQ ID NO: 532. Alternatively, the sense strand is SEQ ID NO: 717 and the antisense strand is SEQ ID NO: 718.

One of skill in the art appreciates that in some embodiments, the sequences presented in the Sequence Listing are referred to in describing the structure of an oligonucleotide (e.g., a ds oligonucleotide such as a RNAi oligonucleotide) or other nucleic acid. In such embodiments, the actual oligonucleotide or other nucleic acid has one or more alternative nucleotides (e.g., an RNA counterpart of a DNA nucleotide or a DNA counterpart of an RNA nucleotide) and/or one or more modified nucleotides and/or one or more modified internucleotide linkages and/or one or more other modification when compared with the specified sequence while retaining essentially same or similar complementary properties as the specified sequence.

In some embodiments, an oligonucleotide herein (e.g., a ds oligonucleotide such as a RNAi oligonucleotide) includes a 25-nucleotide sense strand and a 27-nucleotide antisense strand that when acted upon by a Dicer enzyme results in an antisense strand that is incorporated into the mature RISC. In other embodiments, the sense strand of the ds oligonucleotide is longer than 25 nucleotides (e.g., 26, 27, 28, 29, or 30 nucleotides). In other embodiments, the sense strand of the ds oligonucleotide is longer than 27 nucleotides (e.g., 28, 29, 30, 31, 32, 33, 34, 35, 36, 37, 38, 39, or 40 nucleotides).

In some embodiments, the oligonucleotide has one 5' end that is thermodynamically less stable when compared to the other 5' end. In some embodiments, the oligonucleotide is asymmetric and includes a blunt end at the 3' end of a sense strand and a 3' overhang at the 3' end of an antisense strand. In some embodiments, the 3' overhang on the antisense strand is about 1 to about 8 nucleotides in length (e.g., 1, 2, 3, 4, 5, 6, 7, or 8 nucleotides in length). Typically, a ds oligonucleotide for RNAi has a two-nucleotide overhang on the 3' end of the antisense strand. However, other overhangs are possible. In some embodiments, an overhang is a 3' overhang having a length of between about 1 to about 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5, or 6 nucleotides. However, in other embodiments, the overhang is a 5' overhang comprising a length of between about 1 to about 6 nucleotides, optionally 1 to 5, 1 to 4, 1 to 3, 1 to 2, 2 to 6, 2 to 5, 2 to 4, 2 to 3, 3 to 6, 3 to 5, 3 to 4, 4 to 6, 4 to 5, 5 to 6 nucleotides, or 1, 2, 3, 4, 5, or 6 nucleotides.

In some embodiments, 2 terminal nucleotides on the 3' end of an antisense strand are modified. In some embodiments, the 2 terminal nucleotides on the 3' end of the antisense strand are complementary with the target mRNA (e.g., SCAP mRNA). In other embodiments, the 2 terminal nucleotides on the 3' end of the antisense strand are not complementary with the target mRNA. In some embodiments, the 2 terminal nucleotides on the 3' end of the antisense strand of an oligonucleotide herein are unpaired. In some embodiments, 2 terminal nucleotides on each 3' end of an oligonucleotide in the nicked tetraL structure are GG. Typically, one or both of the 2 terminal GG nucleotides on each 3' end of a ds oligonucleotide are not complementary with the target mRNA.

In some embodiments, there is one or more (e.g., 1, 2, 3, 4, or 5) mismatch(s) between the sense and antisense strand. If there is more than one mismatch between the sense and antisense strand, they may be positioned consecutively (e.g., 2, 3, or more in a row), or interspersed throughout the region of complementarity. In some embodiments, the 3' end of the sense strand contains one or more mismatches. In certain embodiments, two mismatches are incorporated at the 3' end of the sense strand. In some embodiments, base mismatches, or destabilization of segments at the 3' end of the sense strand of the oligonucleotide improves or increases the potency of the ds oligonucleotide.

In some embodiments, there is one or more (e.g., 1, 2, 3, 4, or 5) mismatch(s) between a sense and antisense strand comprising an oligonucleotide herein (e.g., a ds oligonucleotide such as a RNAi oligonucleotide). If there is more than one mismatch between a sense and antisense strand, they may be positioned consecutively (e.g., 2, 3 or more in a row), or interspersed throughout the region of complementarity. In some embodiments, the 3' end of the sense strand comprises one or more mismatches. In some embodiments, two (2) mismatches are incorporated at the 3' end of the sense strand. In some embodiments, base mismatches, or destabilization of segments at the 3' end of the sense strand of an oligonucleotide herein improves or increases the potency of the oligonucleotide. In some embodiments, the sense and antisense strands of an oligonucleotide herein comprise nucleotides sequences selected from Table 3, optionally from the group consisting of:

(a) SEQ ID NOs: 139 and 140,
(b) SEQ ID NOs: 147 and 148,
(c) SEQ ID NOs: 221 and 222,
(d) SEQ ID NOs: 273 and 274,
(e) SEQ ID NOs: 321 and 322,
(f) SEQ ID NOs: 333 and 334, and
(g) SEQ ID NOs: 361 and 362, wherein there is one or more (e.g., 1, 2, 3, 4 or 5) mismatch (s) between the sense and antisense strands.

A. Sense Strands: The oligonucleotides herein (e.g., a ds oligonucleotide such as a RNAi oligonucleotide) include a sense strand sequence including a sequence as set forth in the sense strands of Table 3 or Table 4. In some embodiments, the oligonucleotide includes a sense strand that having at least about 12 (e.g., at least 12, at least 13, at least 14, at least 15, at least 16, at least 17, at least 18, at least 19, at least 20, at least 21, at least 22, or at least 23) contiguous nucleotides of a sequence as set forth in in any one of SEQ ID NOs: 139, 147, 221, 273, 321, 333 and 361, or a sense strand having a nucleotide sequence of any one of SEQ ID NOs: 140, 148, 222, 274, 322, 334 and 362.

Further, the oligonucleotide can include a sense strand of up to about 50 nucleotides in length (e.g., up to 50, up to 40, up to 36, up to 30, up to 27, up to 25, up to 21, up to 19, up to 17, or up to 12 nucleotides in length). In some embodiments, the oligonucleotide can have a sense strand of at least about 12 nucleotides in length (e.g., at least 12, at least 15, at least 19, at least 21, at least 25, at least 27, at least 30, at least 36, or at least 38 nucleotides in length). Alternatively, the oligonucleotide can have a sense strand in a range of about 12 to about 40 (e.g., 12 to 40, 12 to 36, 12 to 32, 12 to 28, 15 to 40, 15 to 36, 15 to 32, 15 to 28, 17 to 21, 17 to 25, 19 to 27, 19 to 30, 20 to 40, 22 to 40, 25 to 40, or 32 to 40) nucleotides in length. In certain embodiments, the oligonucleotide can have a sense strand of 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides in length.

In some embodiments, the sense strand comprises a stem-loop structure at its 3' end. In other embodiments, the sense strand comprises a stem-loop structure at its 5' end. In some embodiments, the stem-loop is formed by intrastrand base pairing. In additional embodiments, the stem is a duplex of about 2, 3, 4, 5, 6, 7, 8, 9, 10, 11, 12, 13, or 14 bp in length. In some embodiments, the stem of the stem-loop comprises a duplex of 2 nucleotides in length. In some embodiments, the stem of the stem-loop comprises a duplex of 3 nucleotides in length. In some embodiments, the stem of the stem-loop comprises a duplex of 4 nucleotides in length. In some embodiments, the stem of the stem-loop comprises a duplex of 5 nucleotides in length. In some embodiments, the stem of the stem-loop comprises a duplex of 6 nucleotides in length. In some embodiments, the stem of the stem-loop comprises a duplex of 7 nucleotides in length. In some embodiments, the stem of the stem-loop comprises a duplex of 8 nucleotides in length. In some embodiments, the stem of the stem-loop comprises a duplex of 9 nucleotides in length. In some embodiments, the stem of the stem-loop comprises a duplex of 10 nucleotides in length. In some embodiments, the stem of the stem-loop comprises a duplex of 11 nucleotides in length. In some embodiments, the stem of the stem-loop comprises a duplex of 12 nucleotides in length. In some embodiments, the stem of the stem-loop comprises a duplex of 13 nucleotides in length. In some embodiments, the stem of the stem-loop comprises a duplex of 14 nucleotides in length.

In some embodiments, the stem-loop provides the oligonucleotide protection against degradation (e.g., enzymatic degradation) and facilitates or improves targeting and/or delivery to a target cell, tissue, or organ (e.g., the liver), or both. For example, the L of the stem-loop provides nucleotides having one or more modifications that facilitate, improve, or increase targeting to a target mRNA (e.g., a SCAP mRNA), inhibiting of target gene expression (e.g., SCAP activity), and/or delivering to a target cell, tissue, or organ (e.g., the liver), or both. In some embodiments, the stem-loop itself or modification(s) to the stem-loop do not substantially affect the inherent gene expression inhibition activity of the oligonucleotide, but facilitates, improves, or increases stability (e.g., provides protection against degradation) and/or delivery of the oligonucleotide to a target cell, tissue, or organ (e.g., the liver). In certain embodiments, the oligonucleotide comprises a sense strand including (e.g., at its 3' end) a stem-loop set forth as: S1-L-S2, in which S1 is complementary to S2, and in which L forms a ss loop between S1 and S2 of up to about 10 nucleotides in length (e.g., 3, 4, 5, 6, 7, 8, 9, or 10 nucleotides in length). In some embodiments, L is 3 nucleotides in length (referred to herein as "triloop" or "triL"). In some embodiments, L is 4 nucleotides in length (referred to herein as "tetraloop" or "tetraL"). In some embodiments, L is 5 nucleotides in length. In some embodiments, L is 6 nucleotides in length. In some embodiments, L is 7 nucleotides in length. In some embodiments, L is 8 nucleotides in length. In some embodiments, L is 9 nucleotides in length. In some embodiments, L is 10 nucleotides in length. In certain embodiments, L is 4 nucleotides in length. FIG. 1 depicts a non-limiting example of such an oligonucleotide. In some embodiments L of the stem-loop having the structure S1-L-S2 as described above is a tetraL (e.g., within a nicked tetraL structure). In some embodiments, the tetraL comprises ribonucleotides, deoxyribonucleotides, modified nucleotides, delivery ligands and combinations thereof. In certain embodiments, the tetraL comprises the sequence 5'-GAAA-3'. In other certain embodiments, the stem-loop comprises the sequence 5'-GCAGCCGAAAGGCUGC-3' (SEQ ID NO: 784).

In some embodiments, the oligonucleotide comprises a targeting sequence or a region of complementary that is complementary to a contiguous sequence of nucleotides of any one of the odd numbers of SEQ ID NOs: 785-1168, especially any one of SEQ ID NOs: 915, 923, 997, 1049, 1097, 1109, and 1137, and the oligonucleotide comprises a sense strand comprising (e.g., at its 3' end) a stem-loop set forth as: S1-L-S2, in which S1 is complementary to S2, and in which L forms a single-stranded loop between S1 and S2 of up to about 10 nucleotides in length (e.g., 3, 4, 5, 6, 7, 8, 9, or 10 nucleotides in length). In some embodiments, the oligonucleotide comprises a targeting sequence or a region of complementary that is complementary to a contiguous sequence of nucleotides of any one of the odd numbers of SEQ ID NOs: 785-1168, especially any one of SEQ ID NOs: 915, 923, 997, 1049, 1097, 1109, and 1137, and the oligonucleotide comprises a sense strand comprising (e.g., at its 3' end) a stem-loop set forth as: S1-L-S2, in which S1 is complementary to S2, and in which L forms a single-stranded loop between S1 and S2 of 4 nucleotides in length.

In some embodiments, L of a stem-loop having the structure S1-L-S2 as described herein is a triL. In some embodiments, the oligonucleotide comprises a targeting sequence or a region of complementary that is complementary to a contiguous sequence of nucleotides of any one of the odd numbers of SEQ ID NOs: 785-1168, especially any one of SEQ ID NOs: 915, 923, 997, 1049, 1097, 1109, and 1137 and a triL. In some embodiments, the triL comprises ribonucleotides, deoxyribonucleotides, modified nucleotides, ligands (e.g., delivery ligands), and combinations thereof.

In some embodiments, L of a stem-loop having the structure S1-L-S2 as described above is a tetraL. In some embodiments, the oligonucleotide comprises a targeting sequence or a region of complementary that is complementary to a contiguous sequence of nucleotides of any one of the odd numbers of SEQ ID NOs: 785-1168, especially any one of SEQ ID NOs: 915, 923, 997, 1049, 1097, 1109, and 1137 and a tetraL. In some embodiments, the tetraL comprises ribonucleotides, deoxyribonucleotides, modified nucleotides, ligands (e.g., delivery ligands), and combinations thereof.

B. Antisense Strands: The oligonucleotides herein (e.g., a ds oligonucleotide such as a RNAi oligonucleotide) include an antisense strand including a sequence as set forth in the antisense strands of Table 3 (unmodified) or Table 4 (modified). In some embodiments, the oligonucleotide includes an antisense strand having at least about 12 (e.g., at least 12, at least 13, at least 14, at least 15, at least 16, at least 17, at least 18, at least 19, at least 20, at least 21, at least 22, or at least 23) contiguous nucleotides of a sequence as set forth in any one of SEQ ID NOs: 139, 147, 221, 273, 321, 333, and 361, or an antisense strand having a nucleotide sequence of any one of SEQ ID NOs: 140, 148, 222, 274, 322, 334, and 362.

Further, the oligonucleotide can include an antisense strand of up to about 50 nucleotides in length (e.g., up to 50, up to 40, up to 35, up to 30, up to 27, up to 25, up to 21, up to 19, up to 17 or up to 12 nucleotides in length). In some embodiments, an oligonucleotide comprises an antisense strand of at least about 12 nucleotides in length (e.g., at least 12, at least 15, at least 19, at least 21, at least 22, at least 25, at least 27, at least 30, at least 35 or at least 38 nucleotides in length). In some embodiments, an oligonucleotide comprises an antisense strand in a range of about 12 to about 40 (e.g., 12 to 40, 12 to 36, 12 to 32, 12 to 28, 15 to 40, 15 to 36, 15 to 32, 15 to 28, 17 to 22, 17 to 25, 19 to 27, 19 to 30, 20 to 40, 22 to 40, 25 to 40 or 32 to 40) nucleotides in length. In some embodiments, an oligonucleotide comprises antisense strand of 15 to 30 nucleotides in length. In some embodiments, an antisense strand of any one of the oligonucleotides disclosed herein is of 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length. In some embodiments, an oligonucleotide comprises an antisense strand of 22 nucleotides in length.

In some embodiments, the oligonucleotide comprises an antisense strand comprising or consisting of a sequence as set forth in Table 3 (e.g., any one of the even numbers of SEQ ID NOs: 9 to 392). In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22 or at least 23) contiguous nucleotides of a sequence as set forth in Table 3 (e.g., any one of the even numbers of SEQ ID NOs: 9 to 392). In some embodiments, an oligonucleotide disclosed herein for targeting SCAP comprises an antisense strand comprising or consisting of a sequence as set forth as set forth in Table 3 (e.g., any one of the even numbers of SEQ ID NOs: 9 to 392), especially any one of SEQ ID NOs: 140, 148, 222, 274, 322, 334, and 362. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22 or at least 23) contiguous nucleotides of a sequence as set forth in Table 4 (e.g., any one of the even numbers of SEQ ID NOs: 393 to 776. In some embodiments, an oligonucleotide disclosed herein for targeting SCAP comprises an antisense strand comprising or consisting of a sequence as set forth in any one of SEQ ID NOs: 524, 532, 606, 658, 706, 718, and 746. In some embodiments, an oligonucleotide herein comprises an antisense strand comprising at least about 12 (e.g., at least 12, at least 13, at least 14, at least 15, at least 16, at least 17, at least 18, at least 19, at least 20, at least 21, at least 22 or at least 23) contiguous nucleotides of a sequence as set forth in any one of SEQ ID NOs: SEQ ID NOs: 524, 532, 606, 658, 706, 718, and 746.

C. Duplex Length: The oligonucleotides herein (e.g., a ds oligonucleotide such as a RNAi oligonucleotide) include a duplex formed between the sense strand and the antisense strand, which is at least about 12 (e.g., at least 12, at least 13, at least 14, at least 15, at least 16, at least 17, at least 18, at least 19, at least 20, or at least 21) nucleotides in length. In some embodiments, the duplex formed between the sense strand and the antisense strand is in the range of about 12 to about 30 nucleotides in length (e.g., 12 to 30, 12 to 27, 12 to 22, 15 to 25, 18 to 30, 18 to 22, 18 to 25, 18 to 27, 18 to 30, 19 to 30, or 21 to 30 nucleotides in length). In some embodiments, the duplex formed between the sense strand and the antisense strand is 12, 13, 14, 15, 16, 17, 18, 19, 29, 21, 22, 23, 24, 25, 26, 27, 28, 29, or 30 nucleotides in length. In some embodiments, the duplex formed between the sense strand and the antisense strand is 12 nucleotides in length. In some embodiments, the duplex formed between the sense strand and the antisense strand is 13 nucleotides in length. In some embodiments, the duplex formed between the sense strand and the antisense strand is 14 nucleotides in length. In some embodiments, the duplex formed between the sense strand and the antisense strand is 15 nucleotides in length. In some embodiments the duplex formed between the sense strand and the antisense strand is 16 nucleotides in length. In some embodiments, the duplex formed between the sense strand and the antisense strand is 17 nucleotides in length. In some embodiments, the duplex formed between the sense strand and the antisense strand is 18 nucleotides in length. In some embodiments, the duplex formed between the sense strand and the antisense strand is 19 nucleotides in length. In some embodiments, the duplex formed between the sense strand and the antisense strand is 20 nucleotides in length. In some embodiments, the duplex formed between the sense strand and the antisense strand is 21 nucleotides in length. In some embodiments, the duplex formed between the sense strand and the antisense strand is 22 nucleotides in length. In some embodiments, the duplex formed between the sense strand and the antisense strand is 23 nucleotides in length. In some embodiments, the duplex formed between the sense strand and the antisense strand is 24 nucleotides in length. In some embodiments, the duplex formed between the sense strand and the antisense strand is 25 nucleotides in length. In some embodiments, the duplex formed between the sense strand and the antisense strand is 26 nucleotides in length. In some embodiments, the duplex formed between the sense strand and the antisense strand is 27 nucleotides in length. In some embodiments, the duplex formed between the sense strand and the antisense strand is 28 nucleotides in length. In some embodiments, the duplex formed between the sense strand and the antisense strand is 29 nucleotides in length. In some embodiments, the duplex formed between the sense strand and the antisense strand is 30 nucleotides in length. In some embodiments, the duplex formed between the sense strand and the antisense strand does not span the entire length of the sense strand and/or antisense strand. In some embodiments, the duplex formed between the sense strand and the antisense strand spans the entire length of either the sense strand or the antisense strand. In some embodiments, the duplex formed between the sense strand and the antisense strand spans the entire length of both the sense strand and the antisense strand.

D. Oligonucleotide Termini: The oligonucleotides herein (e.g., a ds oligonucleotide such as a RNAi oligonucleotide) comprises a sense strand and an antisense strand, where a terminus of either or both strands comprise a blunt end. In some embodiments, the oligonucleotide comprises sense and antisense strands that are separate strands that form an asymmetric duplex region having an overhang at a 3' terminus of the antisense strand. In some embodiments, the oligonucleotide comprises a sense strand and an antisense strand, where a terminus of either or both strands comprise an overhang comprising one or more nucleotides. In some embodiments, the one or more nucleotides comprising the overhang are unpaired nucleotides. In some embodiments, the oligonucleotide comprises a sense strand and an antisense strand, wherein the 3' terminus of the sense strand and the 5' terminus of the antisense strand comprise a blunt end. In some embodiments, the oligonucleotide comprises a sense strand and an antisense strand, wherein the 5' terminus of the sense strand and the 3' terminus of the antisense strand comprise a blunt end.

In some embodiments, the oligonucleotide comprises a sense strand and an antisense strand, wherein the 3' terminus of either or both strands comprise a 3' overhang comprising one or more nucleotides. In some embodiments, the oligonucleotide comprises a sense strand and an antisense strand, wherein the sense strand comprises a 3' overhang comprising one or more nucleotides. In some embodiments, the oligonucleotide comprises a sense strand and an antisense strand, wherein the antisense strand comprises a 3' overhang comprising one or more nucleotides. In some embodiments, the oligonucleotide comprises a sense strand and an antisense strand, wherein both the sense strand and the antisense strand comprises a 3' overhang comprising one or more nucleotides.

In some embodiments, the 3' overhang is about 1 to about 20 nucleotides in length (e.g., about 1, 2, 3, 4, 5, 6, 7, 8, 9, 10, 11, 12, 13, 14, 15, 16, 17, 18, 19, or 20 nucleotides in length). In some embodiments, the 3' overhang is about 1 to 19, 1 to 18, 1 to 17, 1 to 16, 1 to 15, 1 to 14, 1 to 13, 1 to 12, 1 to 11, 1 to 10, 1 to 9, 1 to 8, 1 to 7, 1 to 6, 1 to 5, 1 to 4, 1 to 3, or 1 to 2 nucleotides in length. In some embodiments, the 3' overhang is 1 nucleotide in length. In some embodiments, the 3' overhang is 2 nucleotides in length. In some embodiments, the 3' overhang is 3 nucleotides in length. In some embodiments, the 3' overhang is 4 nucleotides in length. In some embodiments, the 3' overhang is 5 nucleotides in length. In some embodiments, the 3' overhang is 6 nucleotides in length. In some embodiments, the 3' overhang is 7 nucleotides in length. In some embodiments, the 3' overhang is 8 nucleotides in length. In some embodiments, the 3' overhang is 9 nucleotides in length. In some embodiments, the 3' overhang is 10 nucleotides in length. In some embodiments, the 3' overhang is 11 nucleotides in length. In some embodiments, the 3' overhang is 12 nucleotides in length. In some embodiments, the 3' overhang is 13 nucleotides in length. In some embodiments, the 3' overhang is 14 nucleotides in length. In some embodiments, the 3' overhang is 15 nucleotides in length. In some embodiments, the 3' overhang is 16 nucleotides in length. In some embodiments, the 3' overhang is 17 nucleotides in length. In some embodiments, the 3' overhang is 18 nucleotides in length. In some embodiments, the 3' overhang is 19 nucleotides in length. In some embodiments, the 3' overhang is 20 nucleotides in length.

In certain embodiments, the oligonucleotide comprises a sense strand and an antisense strand, where the antisense strand comprises a 3' overhang.

V. Oligonucleotide Modifications: The oligonucleotides herein (e.g., a ds oligonucleotide such as a RNAi oligonucleotide) include at least one modification. The oligonucleotide may be modified in various ways to improve or control specificity, stability, delivery, bioavailability, resistance from nuclease degradation, immunogenicity, base-pairing properties, RNA distribution and cellular uptake and other features relevant to therapeutic or research use.

In some embodiments, the modification is a modified sugar. In some embodiments, the modification is a 5'-terminal phosphate group. In some embodiments, the modification is a modified internucleotide linkage. In some embodiments, the modification is a modified base. In some embodiments, the oligonucleotide comprises any one of the modifications described herein or any combination thereof. For example, in some embodiments, the oligonucleotide comprises at least one modified sugar, a 5'-terminal phosphate group, at least one modified internucleotide linkage, and at least one modified base. In some embodiments, the sense and antisense strands of the oligonucleotide comprise nucleotide sequences selected from Table 3, optionally the group consisting of:

(a) SEQ ID NOs: 139 and 140,
(b) SEQ ID NOs: 147 and 148,
(c) SEQ ID NOs: 221 and 222,
(d) SEQ ID NOs: 273 and 274,
(e) SEQ ID NOs: 321 and 322,
(f) SEQ ID NOs: 333 and 334, and
(g) SEQ ID NOs: 361 and 362, wherein the oligonucleotide comprises at least one modified sugar, a 5'-terminal phosphate group, at least one modified internucleotide linkage, and at least one modified base.

In other embodiments, the oligonucleotide comprises a sense strand and an antisense strand having a modification pattern according to:

Sense Strand: 5'-mX-S-mX-mX-mX-mX-mX-mX-fX-fX-fX-fX-mX-mX-mX-mX-mX-mX-mX-mX-mX-mX-mX-mX-mX-mX-mX-mX-[ademX-GalNAc]-[ademX-GalNAc]-[ademX-GalNAc]-mX-mX-mX-mX-mX-mX-3' hybridized to:

Antisense Strand: 5'-[MePhosphonate-4O-mX]-S-fX-S-fX-S-fX-fX-mX-fX-mX-mX-fX-mX-mX-mX-fX-mX-mX-mX-mX-mX-mX-S-mX-S-mX-3', wherein mX=2'-OMe-modified nucleotide, fX=2-F-modified nucleotide, -S-=phosphorothioate linkage, -=phosphodiester linkage, [MePhosphonate-4O-mX]=4'-O-monomethylphosphonate-2'-O-methyl-modified nucleotide, and ademX-GalNAc=GalNAc attached to a nucleotide, and wherein the sense stand and the antisense strand comprise nucleotide sequences selected from Table 3, optionally from the group consisting of:

(a) SEQ ID NOs:139 and 140,
(b) SEQ ID NOs:147 and 148,
(c) SEQ ID NOs:221 and 222,
(d) SEQ ID NOs:273 and 274,
(e) SEQ ID NOs:321 and 322,
(f) SEQ ID NOs:333 and 334, and
(g) SEQ ID NOs:361 and 362.

A. Sugar Modifications: A modified sugar (also referred to herein as a sugar analog) includes a modified deoxyribose or ribose moiety in which, for example, one or more modifications occur at the 2', 3', 4', and/or 5' carbon position of the sugar. A modified sugar also includes non-natural, alternative, carbon structures such as those present in locked nucleic acids ("LNA"; see, e.g., Koshkin et al. (1998) Tetrahedron 54:3607-30), unlocked nucleic acids ("UNA"; see, e.g., Snead et al. (2013) Mol. Ther-Nuc. Acids 2:e103) and bridged nucleic acids ("BNA"; see, e.g., Imanishi & Obika (2002) Chem. Commun. 16:1653-59).

In some embodiments, the nucleotide modification in the sugar is a 2-modification such as, for example, 2'-O-propargyl, 2-O-propylamin, 2'-amino, 2'-ethyl, 2'-F, 2'-aminoethyl (EA), 2'-OMe, 2'-MOE, 2'-O-[2-(methylamino)-2-oxoethyl] (2'-O-NMA), or 2'-FANA. In certain embodiments, the modification is 2'-F, 2'-OMe, or 2'-MOE. In other embodiments, the modification in the sugar is a modification of the sugar ring, which includes modification of one or more carbons of the sugar ring. For example, the modification in the sugar is a 2'-oxygen of the sugar linked to a 1-carbon or 4'-carbon of the sugar, or a 2'-oxygen linked to the 1'-carbon or 4'-carbon via an ethylene or methylene bridge. In other embodiments, the modification is an acyclic sugar that lacks a 2'-carbon to 3'-carbon bond. In other embodiments, the modification is a thiol group such as, for example, in the 4' position of the sugar.

The oligonucleotides herein include at least 1 modified nucleotide (e.g., at least 1, at least 5, at least 10, at least 15, at least 20, at least 25, at least 30, at least 35, at least 40, at least 45, at least 50, at least 55, at least 60, or more). In some embodiments, the sense strand comprises at least 1 modified nucleotide (e.g., at least 1, at least 5, at least 10, at least 15, at least 20, at least 25, at least 30, at least 35, or more). In some embodiments, the antisense strand comprises at least 1 modified nucleotide (e.g., at least 1, at least 5, at least 10, at least 15, at least 20, or more).

In certain embodiments, all nucleotides of the sense strand except the tetraL are modified. Likewise, all nucleotides of the antisense strand are modified. In some embodiments, all the nucleotides of the oligonucleotide (i.e., paired nucleotides of the sense strand and the antisense strand) are modified. As above, and in some embodiments, the modified nucleotide is a 2-modification (e.g., a 2'-F, 2'-OMe, 2'-MOE, and/or 2'-FANA. In certain embodiments, the modified nucleotide is a 2-modification such as, for example, a 2'-F or a 2'-OMe.

In some embodiments, the oligonucleotide comprises a sense strand with about 10-15%, 10%, 11%, 12%, 13%, 14%, or 15% of the nucleotides of the sense strand comprising a 2'-F modification. In some embodiments, the oligonucleotide comprises a sense strand with about 18-23% (e.g., 18%, 19%, 20%, 21%, 22%, or 23%) of the nucleotides of the sense strand comprising a 2'-F modification. In some embodiments, the oligonucleotide comprises a sense strand with about 38-43% (e.g., 38%, 39%, 40%, 41%, 42%, or 43%) of the nucleotides of the sense strand comprising a 2'-F modification. In some embodiments, about 11% of the nucleotides of the sense strand comprise a 2'-F modification. In some embodiments, about 22% of the nucleotides of the sense strand comprise a 2'-F modification. In some embodiments, about 40% of the nucleotides of the sense strand comprise a 2'-F modification. In some embodiments, the oligonucleotide comprises an antisense strand with about 25% to about 35% (e.g., 25%, 26%, 27%, 28%, 29%, 30%, 31%, 32%, 33%, 34%, or 35%) of the nucleotides of the antisense strand comprising a 2'-F modification. In some embodiments, about 32% of the nucleotides of the antisense strand comprise a 2'-F modification. In some embodiments, the oligonucleotide has about 15% to about 25% (e.g., 15%, 16%, 17%, 18%, 19%, 20%, 21%, 22%, 23%, 24%, or 25%) of its nucleotides comprising a 2'-F modification. In some embodiments, the oligonucleotide has about 35-45% (e.g., 35%, 36%, 37%, 38%, 39%, 40%, 41%, 42%, 43%, 44% or 45%) of its nucleotides comprising a 2'-F modification. In some embodiments, about 19% of the nucleotides in the oligonucleotide comprise a 2'-F modification. In some embodiments, about 29% of the nucleotides in the oligonucleotide comprise a 2'-F modification. In some embodiments, about 40% of the nucleotides in the oligonucleotide comprise a 2'-F modification.

Moreover, the oligonucleotides herein can have different modification patterns. In some embodiments, the modified oligonucleotide comprise a sense strand sequence having a modification pattern as set forth in Table 4 (as well as FIG. 1) and an antisense strand having a modification pattern as set forth in Table 4. In some embodiments, one or more of positions 8, 9, 10, or 11 of the sense strand are modified with a 2'-F. In other embodiments, the sugar moiety at each nucleotide at positions 1 to 7, 12 to 27 and 31 to 36 in the sense strand is modified with a 2'-OMe. In certain embodiments, positions 8 to 11 of the sense strand are modified with a 2'-F and positions 1 to 7, 12 to 27 and 31 to 36 are modified with a 2'-OMe.

In certain additional embodiments, a sense strand comprising a 2'-F modified nucleotide at positions 8-11, a 2'-OMe modified nucleotide at positions 1 to 7, 12 to 27 and 31 to 36, a GalNAc-conjugated nucleotide at position 28, 29 and 30, and a phosphorothioate linkage between positions 1 and 2.

In some embodiments, the antisense strand comprises one or more nucleotides at positions 2-5, 7, 10 and 14 modified with 2'-F, and one or more nucleotides at positions 1, 6, 8 to 9, 11 to 13 and 15 to 22 modified with a 2'-OMe. Certain embodiments disclose an oligonucleotide with an antisense strand comprising a 2'-F-modified nucleotide at positions 2 to 5, 7, 10 and 14, and a 2'-OMe-modified nucleotide at positions 1, 6, 8 to 9, 11 to 13 and 15 to 22.

In certain embodiments, the antisense strand comprises a 2'-F modified nucleotide at positions 2 to 5, 7, 10 and 14, a 2'-OMe at positions 1, 6, 8 to 9, 11 to 13 and 15 to 22, a phosphorothioate linkage between positions 1 and 2, positions 2 and 3, positions 3 and 4, positions 20 and 21, and positions 21 and 22.

B. 5'-Terminal Phosphates: 5'-terminal phosphate groups can be used to enhance the interaction of the oligonucleotides herein with Ago2. However, oligonucleotides having a 5'-phosphate group may be susceptible to degradation via phosphatases or other enzymes, which can limit their bioavailability in vivo. In some embodiments, the oligonucleotides herein (e.g., a ds oligonucleotide) comprise analogs of 5' phosphates that are resistant to such degradation. Examples of such phosphate analogs include, but are not limited to, oxymethyl phosphonate, vinyl phosphonate, malonyl phosphonate, or a combination thereof. In certain embodiments the 3' end of a strand of the oligonucleotides is attached to a chemical moiety that mimics the electrostatic and steric properties of a natural 5'-phosphate group ("phosphate mimic").

Alternatively, or additionally, the oligonucleotides herein have a phosphate analog at a 4'-carbon position of the sugar (referred to as a "4'-phosphate analog"). See, e.g., Intl. Patent Application Publication No. WO 2018/045317. In some embodiments, the oligonucleotides herein include a 4'-phosphate analog at a 5'-terminal nucleotide. In some embodiments, the phosphate analog is an oxymethyl phosphonate, in which the oxygen atom of the oxymethyl group is bound to the sugar moiety (e.g., at its 4'-carbon) or analog thereof. In other embodiments, the 4'-phosphate analog is a thiomethylphosphonate or an aminomethylphosphonate, in which the sulfur atom of the thiomethyl group or the nitrogen atom of the amino methyl group is bound to the 4'-carbon of the sugar moiety or analog thereof. In certain embodiments, the 4'-phosphate analog is an oxymethylphosphonate, which is represented by the formula $—O—CH_2—PO(OH)_2$ or $—O—CH_2—PO(OR)_2$, in which R is independently selected from H, $CH_3$, an alkyl group, $CH_2CH_2CN$, $CH_2OCOC(CH_3)_3$, $CH_2OCH_2CH_2Si(CH_3)_3$, or a protecting group. In certain embodiments, the alkyl group is $CH_2CH_3$. In certain other embodiments, R is independently selected from H, $CH_3$, or $CH_2CH_3$.

C. Modified Internucleotide Linkages: In addition to the above modifications, the oligonucleotides herein (e.g., a ds oligonucleotide) comprise a modified internucleotide linkage. In some embodiments, phosphate modifications or substitutions result in oligonucleotides that comprise at least about 1 (e.g., at least 1, at least 2, at least 3, or at least 5) modified internucleotide linkages. In some embodiments, the oligonucleotides herein (e.g., a ds oligonucleotide) comprise about 1 to about 10 (e.g., 1 to 10, 2 to 8, 4 to 6, 3 to 10, 5 to 10, 1 to 5, 1 to 3, or 1 to 2) modified internucleotide linkages. In other embodiments, the oligonucleotides comprise 1, 2, 3, 4, 5, 6, 7, 8, 9, or 10 modified internucleotide linkages.

Examples of modified internucleotide linkages include, but are not limited, to, a phosphorodithioate linkage, a phosphorothioate linkage, a phosphotriester linkage, a thionoalkylphosphonate linkage, a thionalkylphosphotriester linkage, a phosphoramidite linkage, a phosphonate linkage, or a boranophosphate linkage. In some embodiments, at least one modified internucleotide linkage of any one of the oligonucleotides as disclosed herein is a phosphorothioate linkage.

In some embodiments, the oligonucleotides herein include a phosphorothioate linkage between one or more of positions 1 and 2 of the sense strand, positions 1 and 2 of the antisense strand, positions 2 and 3 of the antisense strand, positions 3 and 4 of the antisense strand, positions 20 and 21 of the antisense strand, and positions 21 and 22 of the antisense strand. In other embodiments, the oligonucleotides comprise a phosphorothioate linkage between each of positions 1 and 2 of the sense strand, positions 1 and 2 of the antisense strand, positions 2 and 3 of the antisense strand, positions 3 and 4 of the antisense strand positions 20 and 21 of the antisense strand, and positions 21 and 22 of the antisense strand.

In certain embodiments, an oligonucleotide herein includes:

a sense strand having a 2'-F modified nucleotide at positions 8 to 11, a 2'-OMe modified nucleotide at positions 1 to 7, 12 to 27 and 31 to 36, a GalNAc-conjugated nucleotide at position 28, 29 and 30, and a phosphorothioate linkage between positions 1 and 2;

an antisense strand having a 2'-F modified nucleotide at positions 2 to 5, 7, 10 and 14, a 2'-OMe at positions 1, 6, 8 to 9, 11 to 13 and 15 to 22, a phosphorothioate linkage between positions 1 and 2, positions 2 and 3, positions 3 and 4, positions 20 and 21, and positions 21 and 22, and a 5'-terminal nucleotide at position 1 comprising a 4'-phosphate analog, optionally wherein the 5'-terminal nucleotide comprises 4-O-monomethylphosphonate-2'-O-methyl uridine [MePhosphonate-4O-mU]; where positions 1 to 20 of the antisense strand form a duplex region with positions 1 to 20 of the sense strand, where positions 21 to 36 of the sense strand form a stem-loop, where positions 27 to 30 form the loop of the stem-loop, optionally where positions 27 to 30 comprise a tetraL, where positions 21 and 22 of the antisense strand comprise an overhang, and where the sense strand and antisense strands are selected from Table 3, optionally from the group consisting of:

(a) SEQ ID NOs: 139 and 140,
(b) SEQ ID NOs: 147 and 148,
(c) SEQ ID NOs: 221 and 222,
(d) SEQ ID NOs: 273 and 274,
(e) SEQ ID NOs: 321 and 322,
(f) SEQ ID NOs: 333 and 334, and
(g) SEQ ID NOs: 361 and 362.

In certain other embodiments, the modified sense strand and antisense strands are selected from Table 4, optionally from the group consisting of:

(a') SEQ ID NOs: 523 and 524,
(b') SEQ ID NOs: 531 and 532,
(c') SEQ ID NOs:605 and 606,
(d') SEQ ID NOs: 657 and 658,
(e') SEQ ID NOs: 705 and 706,
(f') SEQ ID NOs: 717 and 718, and
(g') SEQ ID NOs: 745 and 746.

D. Base Modifications: In addition to the above modifications, the oligonucleotides herein (e.g., a ds oligonucleotide) also comprise one or more modified nucleobases. In some embodiments, modified nucleobases (also referred to herein as base analogs) are linked at the 1' position of a nucleotide sugar moiety. In some embodiments, the modified nucleobase is a nitrogenous base. In other embodiments, the modified nucleobase does not contain nitrogen atom. See, e.g., US Patent Application Publication No. 2008/0274462. In certain other embodiments, the modified nucleotide is a universal base. However, in certain embodiments, the modified nucleotide does not contain a nucleobase (abasic).

With regard to universal bases, they comprise a heterocyclic moiety located at the 1' position of a nucleotide sugar moiety in a modified nucleotide, or the equivalent position in a nucleotide sugar moiety substitution, that, when present in a duplex, is positioned opposite more than one type of base without substantially altering structure of the duplex. Moreover, and compared to a reference ss nucleic acid (e.g., oligonucleotide) that is fully complementary to a target nucleic acid, a ss nucleic acid having a universal base forms a duplex with the target nucleic acid that has a lower $T_m$ than a duplex formed with the complementary nucleic acid. However, when compared to a reference ss nucleic acid in which the universal base has been replaced with a base to generate a single mismatch, the ss nucleic acid having the universal base forms a duplex with the target nucleic acid that has a higher $T_m$ than a duplex formed with the nucleic acid having the mismatched base.

Exemplary universal-binding nucleotides include, but are not limited to, inosine, 1-β-D-ribofuranosyl-5-nitroindole and/or 1-β-D-ribofuranosyl-3-nitropyrrole (see, e.g., US Patent Application Publication No. 2007/0254362; Van Aerschot et al. (1995) Nucleic Acids Res. 23:4363-70; Loakes et al. (1995) Nucleic Acids Res. 23:2361-66; and Loakes & Brown (1994) Nucleic Acids Res. 22:4039-403).

E. Reversible Modifications: While certain modifications can be made to protect the oligonucleotides herein (e.g., a ds oligonucleotide such as a RNAi oligonucleotide) from the in vivo environment before reaching target cells, they also can be made to reduce the potency or activity of the oligonucleotides once they reach the cytosol of the target cell. Reversible modifications therefore can be made such that the oligonucleotide retains desirable properties outside of the cell, which are then removed upon entering the cytosolic environment of the cell. Reversible modification can be removed, for example, by the action of an intracellular enzyme or by the chemical conditions inside of a cell (e.g., through reduction by intracellular glutathione).

In some embodiments, a reversibly modified nucleotide comprises a glutathione-sensitive moiety. Typically, oligonucleotides are chemically modified with cyclic disulfide moieties to mask the negative charge created by the internucleotide diphosphate linkages and to improve cellular uptake and nuclease resistance. See, US Patent Application Publication No. 2011/0294869, Intl. Patent Application Publication Nos. WO 2014/088920 and WO 2015/188197, and Meade et al. (2014) Nat. Biotechnol. 32:1256-63. This reversible modification of the internucleotide diphosphate linkages is designed to be cleaved intracellularly by the reducing environment of the cytosol (e.g., glutathione). Earlier examples include neutralizing phosphotriester modifications that are reported to be cleavable inside cells (see, e.g., Dellinger et al. (2003) J. Am. Chem. Soc. 125:940-50).

Some reversible modifications protect the oligonucleotide during in vivo administration (e.g., transit through the blood and/or lysosomal/endosomal compartments of a cell) where the oligonucleotide will be exposed to nucleases and other harsh environmental conditions (e.g., pH). When released into the cytosol of a cell where the levels of glutathione are higher compared to extracellular space, the modification is reversed, and the result is cleaved oligonucleotide. Using reversible, glutathione-sensitive moieties, it is possible to introduce sterically larger chemical groups into the oligonucleotide when compared to the options available using irreversible chemical modifications. This is because these larger chemical groups will be removed in the cytosol and, therefore, should not interfere with the biological activity of the oligonucleotide inside the cytosol of a cell. As a result, these larger chemical groups can be engineered to confer various advantages to the oligonucleotide, such as nuclease resistance, lipophilicity, charge, thermal stability, specificity, and reduced immunogenicity. In some embodiments, the structure of the glutathione-sensitive moiety can be engineered to modify the kinetics of its release.

In some embodiments, the glutathione-sensitive moiety is attached to the sugar of a nucleotide. In certain embodiments, the glutathione-sensitive moiety is attached to the 2'-carbon of the sugar of a modified nucleotide. Additionally, or alternatively, the glutathione-sensitive moiety is attached to the 5'-carbon of a sugar, particularly when the modified nucleotide is the 5'-terminal nucleotide of the oligonucleotide. Additionally, or alternatively, the glutathione-sensitive moiety is attached to the 3'-carbon of sugar, particularly when the modified nucleotide is the 3'-terminal nucleotide of the oligonucleotide. In some embodiments, the glutathione-sensitive moiety includes a sulfonyl group (see, e.g., Intl. Patent Application Publication No. WO 2018/039364).

VI. Targeting Ligands: It is desirable to target the oligonucleotides herein (e.g., a ds oligonucleotide such as a RNAi oligonucleotide) to one or more cells or one or more organs. Such a strategy can help to avoid undesirable effects in other organs or to avoid undue loss of the oligonucleotide to cells, tissue, or organs that would not benefit therefrom. Accordingly, the oligonucleotide can be modified to facilitate targeting and/or delivering to a tissue, cell, or organ (e.g., to facilitate delivering the oligonucleotides to the liver). In some embodiments, the oligonucleotide is modified to facilitate its delivery to the hepatocytes of the liver. In some embodiments, the oligonucleotide comprises at least one nucleotide (e.g., 1, 2, 3, 4, 5, 6, or more nucleotides) conjugated to one or more targeting ligand(s).

Exemplary targeting ligands include, but are not limited to, a carbohydrate, amino sugar, cholesterol, peptide, polypeptide, protein, or part of a protein (e.g., an antibody or antibody fragment), or lipid. In some embodiments, the targeting ligand is an aptamer. For example, the targeting ligand is an Arg-Gly-Asp (RGD) peptide for targeting tumor vasculature or glioma cells, Cys-Arg-Glu-Lys-Ala (CREKA) peptide (SEQ ID NO: 1169) for targeting tumor vasculature or stoma, transferrin, lactoferrin, or an aptamer for targeting transferrin receptors expressed on central nervous system (CNS) vasculature, or an anti-epidermal growth factor receptor (EGFR) antibody for targeting EGFR on glioma cells. In certain embodiments, the targeting ligand is one or more GalNAc moieties.

In some embodiments, 1 or more (e.g., 1, 2, 3, 4, 5, or 6) nucleotides of the oligonucleotides each can be conjugated to a separate targeting ligand. In some embodiments, 2 to 4 nucleotides of the oligonucleotide each are conjugated to a separate targeting ligand. In other embodiments, targeting ligands can be conjugated to 2 to 4 nucleotides at either ends of the sense strand or antisense strand (e.g., targeting ligands are conjugated to a 2 to 4 nucleotide overhang or extension on the 5' or 3' end of the sense strand or antisense strand) such that the targeting ligands resemble bristles of a toothbrush, and the oligonucleotide resembles a toothbrush. For example, the oligonucleotide comprises a stem-loop at either the 5' or 3' end of the sense strand and 1, 2, 3, or 4 nucleotides of the L of the stem-loop may be individually conjugated to a targeting ligand. In some embodiments, the oligonucleotide comprises a stem-loop at the 3' end of the sense strand, where the L of the stem-loop includes a triL or a tetraL, and where the 3 or 4 nucleotides of the triL or tetraL, respectfully, are individually conjugated to a targeting ligand.

GalNAc is a high affinity ligand for the ASGPR, which is primarily expressed on the sinusoidal surface of hepatocyte cells and has a major role in binding, internalizing, and subsequent clearing circulating glycoproteins that contain terminal galactose or GalNAc residues (asialoglycoproteins). Conjugation (either indirect or direct) of GalNAc moieties to the oligonucleotides herein are used to target them to the ASGPR expressed on cells. In some embodiments, the oligonucleotides are conjugated to at least one or more GalNAc moieties, where the GalNAc moieties target the oligonucleotides to an ASGPR expressed on human liver cells (e.g., human hepatocytes).

The oligonucleotides are conjugated directly or indirectly to a monovalent GalNAc. In some embodiments, the oligonucleotides are conjugated directly or indirectly to more than 1 monovalent GalNAc (i.e., is conjugated to 2, 3, or 4 monovalent GalNAc moieties, and is typically conjugated to 3 or 4 monovalent GalNAc moieties). In some embodiments, the oligonucleotides are conjugated to one or more bivalent GalNAc, trivalent GalNAc, or tetravalent GalNAc moieties.

In some embodiments, 1 or more (e.g., 1, 2, 3, 4, 5, or 6) nucleotides of the oligonucleotides each can be conjugated to a GalNAc moiety. In some embodiments, 2 to 4 nucleotides of a L each are conjugated to a separate GalNAc. In other embodiments, 1 to 3 nucleotides of a triL each are conjugated to a separate GalNAc. In some embodiments, the targeting ligands are conjugated to 2 to 4 nucleotides at either end of the sense or antisense strand (e.g., ligands are conjugated to a 2 to 4 nucleotide overhang or extension on the 5' or 3' end of the sense or antisense strand) such that the GalNAc moieties resemble bristles of a toothbrush, and the oligonucleotide resembles a toothbrush. In some embodiments, the GalNAc moieties are conjugated to a nucleotide of the sense strand. For example, 4 GalNAc moieties are conjugated to nucleotides in the L of the sense strand, where each GalNAc moiety is conjugated to 1 nucleotide. In certain embodiments, 3 GalNAc moieties are conjugated to nucleotides in the L of the sense strand, where each GalNAc moiety is conjugated to 1 nucleotide.

In some embodiments, the oligonucleotides herein comprise a GalNAc attached to any one or more nucleotides of a triL or tetraL via any linker described herein, as depicted below (X=heteroatom):

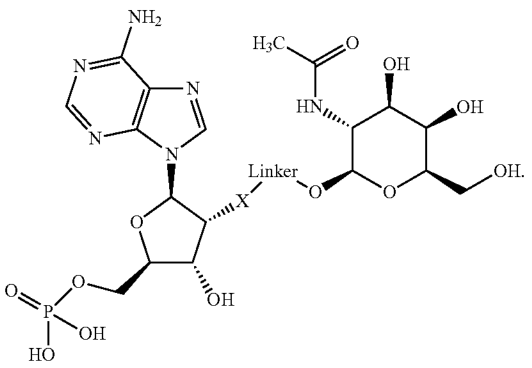

In certain embodiments, the oligonucleotides herein comprise a monovalent GalNAc attached to a guanine nucleotide referred to as 2'-aminodiethoxymethanol-Guanine-GalNAc or [ademG-GalNAc], as depicted below:

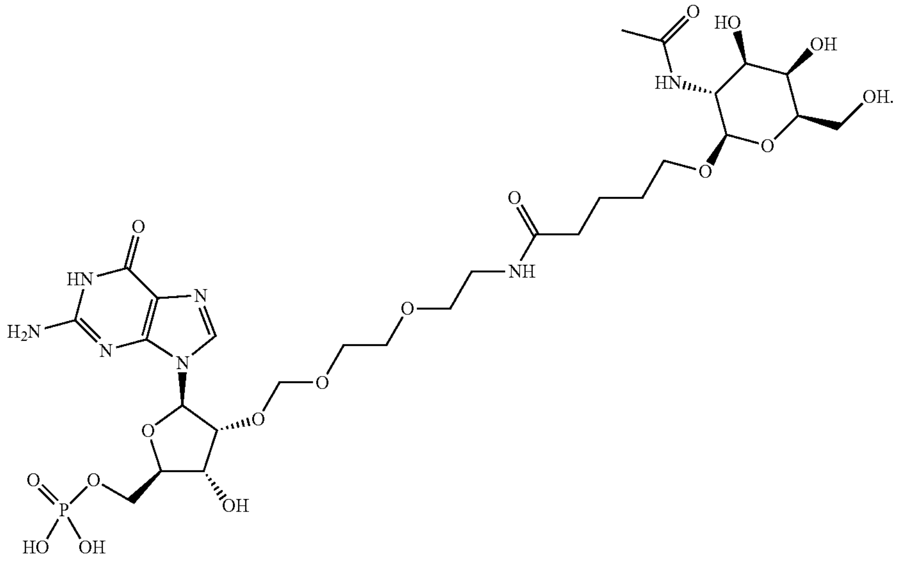 [SMILES: CC(=O)N[C@H]1[C@H](OCCCCC(=O)NCCOCCOCO[C@@H]2[C@H](O)[C@@H](COP(=O)(O)O)O[C@H]2n2cnc3c(=O)[nH]c(N)nc32)O[C@H](CO)[C@H](O)[C@@H]1O]

In certain embodiments, the oligonucleotides herein comprise a monovalent GalNAc attached to an adenine nucleotide, referred to as 2'-aminodiethoxymethanol-Adenine-GalNAc or [ademA-GalNAc], as depicted below:

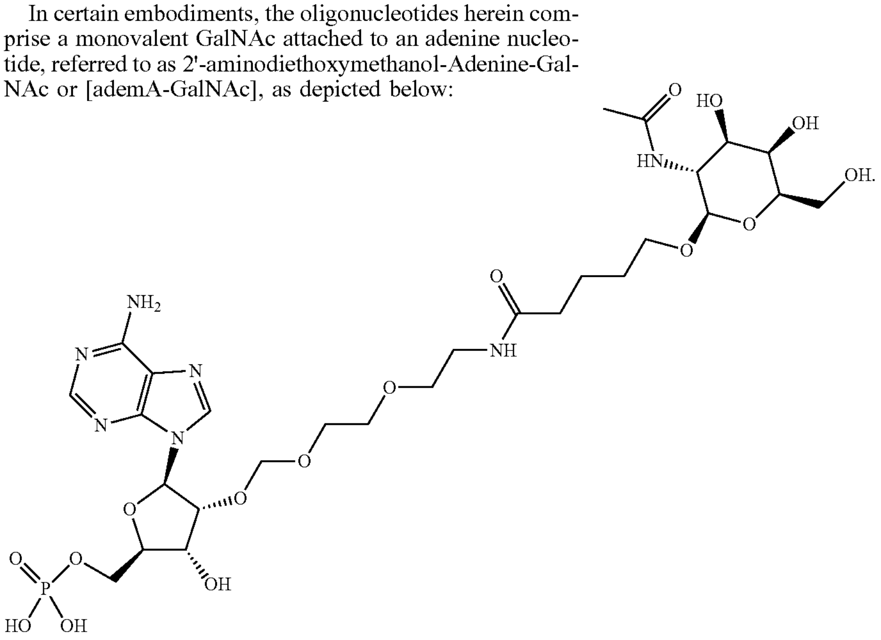

An example of such conjugation is shown below for a tetraL having from 5' to 3', the nucleotide sequence GAAA (L—linker, X—heteroatom), where stem attachment points are shown. Such a tetraL is present, for example, at positions 27-30 of the sense strand listed in Tables 3 and 4, and as shown in FIG. 1. In the chemical formula,

is used to describe an attachment point to the oligonucleotide strand:

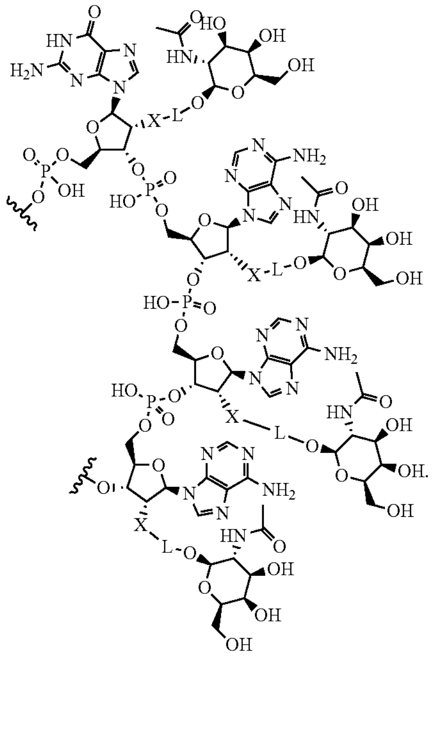

Appropriate methods or chemistry (e.g., click chemistry) are used to link a targeting ligand to a nucleotide. One way of conjugating the targeting ligand to a nucleotide is by using a click linker. In some embodiments, an acetal-based linker is used to conjugate the targeting ligand to a nucleotide of any one of the oligonucleotides herein. Acetal-based linkers are disclosed, for example, in Intl. Patent Application Publication No. WO 2016/100401. In some embodiments, the linker is a labile linker. However, in other embodiments, the linker is stable. An example is shown below for a teraL having from 5' to 3', the nucleotides GAAA, in which GalNAc moieties are attached to nucleotides of the loop using an acetal linker. Such a loop is present, for example, at positions 27-30 of the any one of the sense strands listed in Tables 3 or 4. In the chemical formula,

is an attachment point to the oligonucleotide strand:

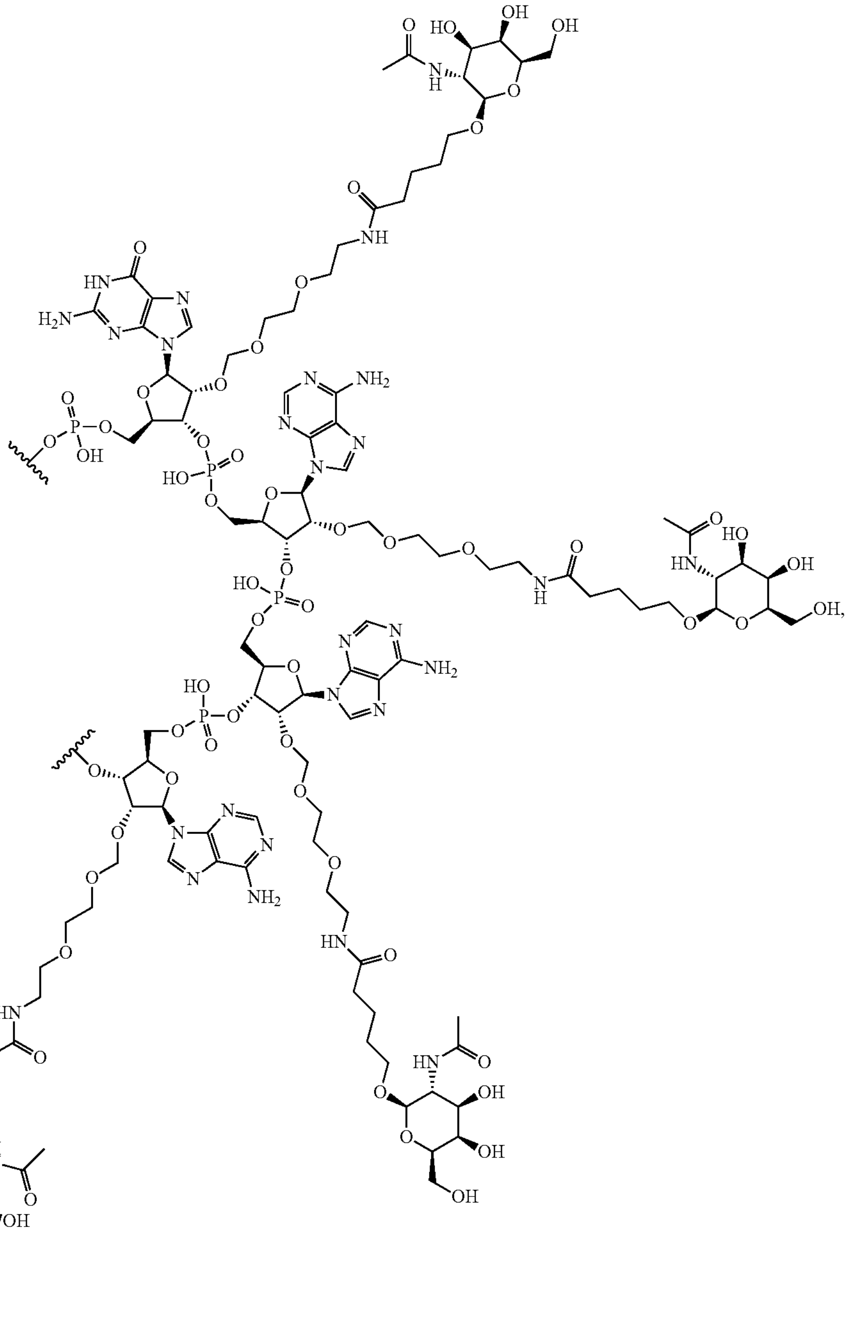

, or

-continued

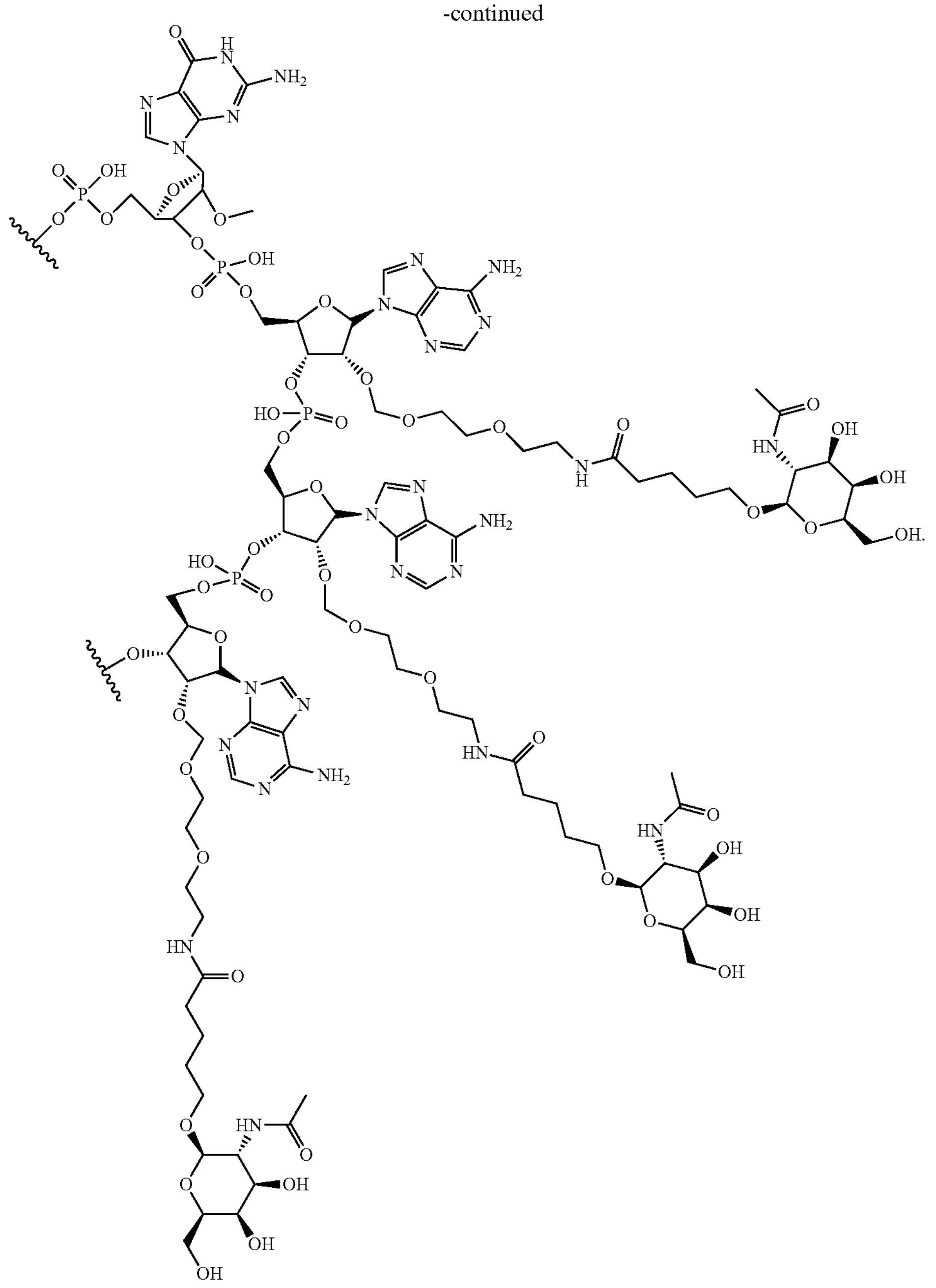

In some embodiments, a duplex extension (e.g., of up to 3, 4, 5, or 6 bp in length) is provided between the targeting ligand (e.g., a GalNAc moiety), and the oligonucleotide. In other embodiments, the oligonucleotide does not have a GalNAc conjugated thereto.

Formulations and Pharmaceutical Compositions

The oligonucleotides herein (e.g., a ds oligonucleotide), or a pharmaceutically acceptable salt thereof (e.g., trifluroacetate salts, acetate salts or hydrochloride salts), are incorporated into a formulation or pharmaceutical composition. Various formulations have been developed to facilitate oligonucleotide use. For example, oligonucleotides can be delivered to an individual or a cellular environment using a formulation that minimizes degradation, facilitates delivery and/or uptake, or provides another beneficial property to the oligonucleotides in the formulation. In some embodiments, the oligonucleotides are formulated in buffer solutions such as phosphate buffered saline solutions, liposomes, micellar structures, and capsids.

To improve in vivo compatibility and effectiveness, the oligonucleotides may be reacted with any of a number of inorganic and organic acids/bases to form pharmaceutically acceptable acid/base addition salts. Pharmaceutically acceptable salts and common methodologies for preparing them are well known in the art (see, e.g., Stahl et al., "Handbook of Pharmaceutical Salts: Properties, Selection and Use," $2^{nd}$ Revised Edition (Wiley-VCH, 2011)). Pharmaceutically acceptable salts for use herein include sodium, trifluoroacetate, hydrochloride and acetate salts.

Formulations of oligonucleotides herein with cationic lipids are used to facilitate transfection of the oligonucleotides into cells. For example, cationic lipids, such as lipofectin, cationic glycerol derivatives, and polycationic molecules (e.g., polylysine) can be used. Suitable lipids include Oligofectamine (ThermoFisher Technologies), Lipofectamine (Life Technologies), NC388 (Ribozyme Pharmaceuticals, Inc.), or FuGene 6 (Roche), all of which are used according to the manufacturer's instructions.

Accordingly, in some embodiments, the formulations herein comprise a liposome, a lipid, a lipid complex, a microsphere, a microparticle, a nanosphere, or a nanoparticle (such as a lipid nanoparticle) or may be otherwise formulated for administration to the cells, tissues, organs, or body of an individual in need thereof (see, e.g., Remington, "The Science and Practice of Pharmacy" (L. V. Allen Jr., ed., $22^{nd}$ Edition, Pharmaceutical Press, 2013).

In some embodiments, the formulations herein further comprise an excipient, which can confer to a composition improved stability, improved absorption, improved solubility and/or therapeutic enhancement of the active ingredient. In some embodiments, the excipient is a buffering agent (e.g., sodium citrate, sodium phosphate, a tris base, or sodium hydroxide) or a vehicle (e.g., a buffered solution, petrolatum, dimethyl sulfoxide, or mineral oil). In some embodiments, the oligonucleotides herein are lyophilized for extending shelf-life and then made into a solution before use (e.g., administration to an individual). Accordingly, the excipient in a pharmaceutical composition including one or more of the oligonucleotides is a lyoprotectant (e.g., mannitol, lactose, polyethylene glycol, or polyvinylpyrrolidone) or a collapse temperature modifier (e.g., dextran, Ficoll™, or gelatin).

Pharmaceutical compositions are formulated to be compatible with its intended route of administration. Routes of administration include, but are not limited to, parenteral (e.g., intravenous, intramuscular, intraperitoneal, intradermal, and subcutaneous), oral (e.g., inhalation), transdermal (e.g., topical), transmucosal, and rectal administration.

Pharmaceutical compositions suitable for injectable use comprise sterile aqueous solutions (where water soluble) or dispersions and sterile powders for the extemporaneous preparation of sterile injectable solutions or dispersion. For intravenous administration, suitable carriers include, but are not limited to, physiological saline, bacteriostatic water, Cremophor EL™ (BASF) or phosphate buffered saline (PBS). The carrier is a solvent or dispersion medium containing, for example, water, ethanol, polyol (e.g., glycerol, propylene glycol, liquid polyethylene glycol, and the like), as well as suitable mixtures thereof. In many embodiments, it will be preferable to comprise in the compositions with isotonic agents such as, for example, sugars, polyalcohols such as mannitol, sorbitol and/or sodium chloride. Sterile injectable solutions are prepared by incorporating the oligonucleotides herein in a required amount in a selected solvent with one or a combination of ingredients enumerated above, as required, followed by filtered sterilization.

Moreover, the pharmaceutical compositions comprise at least about 0.1% of a therapeutic agent (e.g., one or more of the oligonucleotides herein) or more, although the percentage of the therapeutic agent may be between about 1% to about 80% or more of the weight or volume of the total composition. Factors such as solubility, bioavailability, biological half-life, route of administration, product shelf life, as well as other pharmacological considerations will be contemplated by one of skill in the art of preparing such pharmaceutical formulations, and as such, a variety of dosages and treatment regimens may be desirable.

Even though several examples are directed toward liver-targeted delivery of at least one of the oligonucleotides herein, targeting of other tissues also is contemplated.

Kits

The oligonucleotides herein (e.g., a ds oligonucleotide such as a RNAi oligonucleotide) can be incorporated into a kit comprising one or more of the oligonucleotides herein, and instructions for use. In some embodiments, the kit comprises one or more of the oligonucleotides, and a package insert containing instructions for use of the kit and/or any component thereof. In other embodiments, the kit comprises a suitable container, one or more of the oligonucleotides, one or more controls, and various buffers, reagents, enzymes, and other standard ingredients as are known in the art.

In some embodiments, the container can be at least one vial, well, test tube, flask, bottle, syringe, or other container means, into which the one or more oligonucleotides are placed, and in some embodiments, suitably aliquoted. In other embodiments, where an additional component is provided, the kit contains additional containers into which this component is placed. The kit also comprises a means for containing the one or more oligonucleotides and any other reagent in close confinement for commercial sale. Such containers include injection or blow-molded plastic containers into which the desired vials are retained. Containers and/or kits comprise labeling with instructions for use and/or warnings.

In some embodiments, the kit comprises one or more oligonucleotides herein, and a pharmaceutically acceptable carrier, or a pharmaceutical composition comprising one or more of the oligonucleotides and instructions for treating or delaying progression of a disease, disorder, or condition associated with SCAP activity in an individual in need thereof.

Methods

Methods of Making

The oligonucleotides herein (e.g., a ds oligonucleotide such as a RNAi oligonucleotide) are made using methods and/or techniques known to one of skill in the art such as, for example, conventional nucleic acid solid-phase synthesis. The polynucleotides of the oligonucleotides are assembled on a suitable nucleic acid synthesizer utilizing standard nucleotide or nucleoside precursors (e.g., phosphoramidites). Automated nucleic acid synthesizers, including DNA/RNA synthesizers, are commercially available from, for example, Applied Biosystems (Foster City, CA), Bio-Automation (Irving, TX), and GE Healthcare Life Sciences (Pittsburgh, PA).

As one of skill in the art understands, other methods and/or techniques of synthesizing oligonucleotides may be used. Additionally, the various synthetic steps are performed in an alternate sequence or order to give the desired compounds. Other synthetic chemistry transformations, protecting groups (e.g., for hydroxyl, amino, etc. present on the bases), and protecting group methodologies (protection and deprotection) useful in synthesizing the oligonucleotides are known in the art and are described in, for example, Larock, "Comprehensive Organic Transformations," VCH Publishers (1989); Greene & Wuts, Protective Groups in Organic Synthesis, $2^{nd}$ Ed., John Wiley & Sons (1991); Fieser & Fieser, Fieser and Fieser's Reagents for Organic Synthesis, John Wiley & Sons (1994); and Paquette, ed., Encyclopedia of Reagents for Organic Synthesis, John Wiley & Sons (1995).

Methods of Using

I. Methods of Reducing SCAP Activity in Cells, Tissue, Organs, and Organisms:

The oligonucleotides herein (e.g., a ds oligonucleotide such as RNAi oligonucleotides) are used to reduce SCAP mRNA, SCAP protein and/or SCAP activity in cells, tissues, organs, or individuals. The methods comprise the steps described herein, and these may be, but not necessarily, carried out in the sequence as described. Other sequences, however, also are conceivable. Moreover, individual, or multiple steps are carried out either in parallel and/or overlapping in time and/or individually or in multiply repeated steps. Furthermore, the methods comprise additional, unspecified steps.

The methods comprise contacting or delivering to a cell, population of cells, tissues, organs, or individuals an effective amount any of the oligonucleotides herein for reducing SCAP expression. In some embodiments, reduced SCAP activity is determined by measuring a reduction in the amount or level of SCAP mRNA, SCAP protein, and/or SCAP activity in a cell.

With regard to an appropriate cell type, the cell type is any cell that expresses mRNA (e.g., hepatocytes, macrophages, monocyte-derived cells, prostate cancer cells, cells of the brain, endocrine tissue, bone marrow, lymph nodes, lung, gall bladder, liver, duodenum, small intestine, pancreas, kidney, gastrointestinal tract, bladder, adipose and soft tissue, and skin). In some embodiments, the cell is a primary cell obtained from an individual. In some embodiments, the primary cell has undergone a limited number of passages such that the cell substantially maintains is natural phenotypic properties. In some embodiments, the cell is an ex vivo, in vivo, or in vitro cell (i.e., such that one or more of the oligonucleotides herein can be delivered to the cell in culture or to an organism in which the cell resides).

In some embodiments, the oligonucleotides herein are delivered to a cell or population of cells using a nucleic acid delivery method known in the art including, but not limited to, injecting a solution containing the oligonucleotides, bombarding by particles covered by the oligonucleotides, exposing the cell or population of cells to a solution containing the oligonucleotides, or electroporating cell membranes in the presence of the oligonucleotides. Other methods known in the art for delivering oligonucleotides to cells are used such as, for example, lipid-mediated carrier transport, chemical-mediated transport, and cationic liposome transfection such as calcium phosphate, and others.

Reduced SCAP activity is determined by an assay or technique that evaluates one or more molecules, properties or characteristics of a cell or population of cells associated with SCAP gene expression (e.g., using a SCAP expression biomarker) or by an assay or technique that evaluates molecules that are directly indicative of SCAP activity in a cell or population of cells (e.g., SCAP mRNA, SCAP protein and/or SCAP activity). In some embodiments, the extent to which the oligonucleotides reduce SCAP activity are evaluated by comparing SCAP activity in a cell or population of cells contacted with the oligonucleotides to a control cell or population of cells (e.g., a cell or population of cells not contacted with the oligonucleotides or contacted with a control oligonucleotide). In some embodiments, a control amount or level of SCAP activity in a control cell or population of cells is predetermined, such that the control amount or level need not be measured in every instance the assay or technique is performed. The predetermined level or value takes a variety of forms including, but not limited to, a single cut-off value, such as a median or mean.

Contacting or delivering the oligonucleotides herein to a cell or a population of cells result in reduced SCAP activity. In some embodiments, reduced SCAP activity is relative to a control amount or level of SCAP activity in the cell or the population of cells not contacted with the oligonucleotides or contacted with a control oligonucleotide. In some embodiments, reduced SCAP activity is about 1% or lower, about 5% or lower, about 10% or lower, about 15% or lower, about 20% or lower, about 25% or lower, about 30% or lower, about 35% or lower, about 40% or lower, about 45% or lower, about 50% or lower, about 55% or lower, about 60% or lower, about 70% or lower, about 80% or lower, or about 90% or lower relative to a control amount or level of SCAP activity. In some embodiments, the control amount or level of SCAP activity is an amount or level of SCAP mRNA, SCAP protein and/or SCAP activity in the cell or the population of cells that has not been contacted with oligonucleotides herein. In some embodiments, the effect of delivery of the oligonucleotides to the cell or the population of cells according to a method herein is assessed after any finite period or amount of time (e.g., minutes, hours, days, weeks, and/or months). For example, SCAP activity is determined in the cell or the population of cells at least about 4 hours, about 8 hours, about 12 hours, about 18 hours, or about 24 hours. Alternatively, SCAP activity is determined in the cell or the population of cells at least about 1 day, about 2 days, about 3 days, about 4 days, about 5 days, about 6 days, about 7 days, about 8 days, about 9 days, about 10 days, about 11 days, about 12 days, about 13 days, about 14 days, about 21 days, about 28 days, about 35 days, about 42 days, about 49 days, about 56 days, about 63 days, about 70 days, about 77 days, or about 84 days or more after contacting or delivering the oligonucleotides to the cell or population of cells. In other embodiments, SCAP activity is determined in the cell or the population of cells at least about 1 month, about 2 months, about 3 months, about 4 months, about 5 months, or about 6 months or more after contacting or delivering the oligonucleotides to the cell or the population of cells.

In some embodiments, the oligonucleotides herein are delivered in the form of a transgene that is engineered to express in a cell one or more of the oligonucleotides or strands (e.g., sense and antisense strands). For example, the oligonucleotides are delivered using a transgene engineered to express any oligonucleotide herein. Transgenes may be delivered using viral vectors (e.g., adenovirus, retrovirus, vaccinia virus, poxvirus, adeno-associated virus, or herpes simplex virus) or non-viral vectors (e.g., plasmids or synthetic mRNAs). In some embodiments, the transgenes are injected directly to an individual.

II. Methods of Treatment:

Methods of treating an individual having, suspected of having, or at risk of developing a disease, disorder, or condition associated with SCAP activity comprise administering at least one or more of the oligonucleotides herein (e.g., a ds oligonucleotide such as a RNAi oligonucleotide) to the individual. Additionally, methods of treating or attenuating an onset or progression of a disease, disorder, or condition associated with SCAP activity in an individual comprise using one or more of the oligonucleotides herein. Furthermore, methods of achieving one or more therapeutic benefits in an individual having a disease, disorder, or condition associated with SCAP activity comprise providing one or more of the oligonucleotides herein. In some embodiments, the individual can be treated by administering a therapeutically effective amount of any one or more of the oligonucleotides herein. In some embodiments, the treatment comprises reducing SCAP activity. In some embodiments, the individual is treated therapeutically. In some embodiments, the individual is treated prophylactically. In all of these embodiments, the oligonucleotide of interest is selected from Table 3 or 4.

In some embodiments, the one or more oligonucleotides, or a pharmaceutical composition including the same, is administered to the individual having a disease, disorder, or condition associated with SCAP activity such that SCAP activity is reduced in the individual, thereby treating the individual. In some embodiments, an amount or level of SCAP mRNA is reduced in the individual. In other embodiments, an amount or level of SCAP protein is reduced in the individual. In still other embodiments, an amount or level of SCAP activity is reduced in the individual. In yet other embodiments, an amount or level of liver TG (e.g., one or more TG(s) or total TGs in liver) and/or cholesterol is reduced in the individual, especially in the liver. In still other embodiments, an amount or level of liver inflammation can be reduced. In still other embodiments, an amount of level of liver fibrosis is reduced. In still other embodiments, an amount or level of plasma aspartate aminotransferase (AST), plasma alanine aminotransferase (ALT), plasma Cytokeratin 18 (CK-18), or even plasma N-terminal type III collagen propeptide (Pro-C3) is reduced. In any of the above disclosed embodiments, the oligonucleotides comprise a sense strand having a nucleotide sequence of any one of SEQ ID NOs:532, 531, 605, 657, 705, 717 and 745, and an antisense strand having a nucleotide sequence of any one of SEQ ID NOs:524, 532, 606, 658, 706, 718 and 746.

In some embodiments, SCAP activity is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to SCAP activity prior to administering the one or more oligonucleotides or pharmaceutical composition thereof. In other embodiments, SCAP activity is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to SCAP activity in an individual (e.g., a reference or control individual) not receiving the one or more oligonucleotides or pharmaceutical composition or receiving a control oligonucleotide, pharmaceutical composition or treatment.

In certain embodiments, an amount or level of SCAP mRNA is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of SCAP mRNA prior to administering the one or more oligonucleotides or pharmaceutical composition thereof. In some embodiments, the amount or level of SCAP mRNA is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of SCAP mRNA in an individual (e.g., a reference or control individual) not administered the one or more oligonucleotides or pharmaceutical composition or administered a control oligonucleotide, pharmaceutical composition, or treatment.

In certain embodiments, an amount or level of SCAP protein is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of SCAP protein prior to administering the one or more oligonucleotides or pharmaceutical composition thereof. In other embodiments, an amount or level of SCAP protein is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of SCAP protein in an individual (e.g., a reference or control individual) not administered the one or more oligonucleotides or pharmaceutical composition or administered a control oligonucleotide, pharmaceutical composition or treatment.

In certain embodiments, an amount or level of SCAP activity is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of SCAP activity prior to administering the one or more oligonucleotides or pharmaceutical composition thereof. In some embodiments, the amount or level of SCAP activity is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of SCAP activity in an individual (e.g., a reference or control individual) not administered the one or more oligonucleotides or pharmaceutical composition or administered a control oligonucleotide, pharmaceutical composition or treatment.

In certain embodiments, an amount or level of TG, especially liver TG, can be reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of TG prior to administering the one or more oligonucleotides or pharmaceutical composition thereof. In some embodiments, the amount or level of TG is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of TG in an individual (e.g., a reference or control individual) not administered the one or more oligonucleotides or pharmaceutical composition or administered a control oligonucleotide, pharmaceutical composition or treatment.

In certain embodiments, an amount or level of cholesterol, especially liver cholesterol, can be reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of cholesterol prior to administering the one or more oligonucleotides or pharmaceutical composition thereof. In some embodiments, the amount or level of cholesterol is reduced in the individual by at least about 30%, about 35%, about 40%, about 45%, about 50%, about 55%, about 60%, about 65%, about 70%, about 75%, about 80%, about 85%, about 90%, about 95%, about 99%, or greater than 99% when compared to an amount or level of cholesterol in an individual (e.g., a reference or control individual) not administered the one or more oligonucleotides or pharmaceutical composition or administered a control oligonucleotide, pharmaceutical composition or treatment.

Here, SCAP activity, the amount or level of SCAP mRNA, SCAP protein, SCAP activity, liver TG, liver cholesterol, or any combination thereof, is reduced in a cell (e.g., a hepatocyte), a population or a group of cells (e.g., an organoid), a tissue (e.g., liver tissue), a sample (e.g., a liver biopsy sample), an organ (e.g., liver), blood or a fraction thereof (e.g., plasma), or any other biological material obtained or isolated from the individual. In some embodiments, SCAP activity, the amount or level of SCAP mRNA, SCAP protein, SCAP activity, TG, cholesterol, or any combination thereof, is reduced in more than one type of cell (e.g., a hepatocyte and one or more other type(s) of cell), more than one groups of cells, more than one type of tissue (e.g., liver tissue and one or more other type(s) of tissue), more than one type of sample (e.g., a liver biopsy sample and one or more other type(s) of biopsy sample), more than one organ (e.g., liver and one or more other organ(s)), more than one fraction of blood (e.g., plasma and one or more other blood fraction(s)) obtained or isolated from the individual.

Examples of a disease, disorder, or condition associated with SCAP activity include, but are not limited to, AH, ALD, CCA, cirrhosis, hepatic fibrosis, hepatic inflammation, HCC, liver steatosis, NAFLD, NASH and PSC, as well as related diseases, disorders, and conditions in an individual such as, for example, hypercholesterolemia, hyperlipidemia, hypertriglyceridemia, ASCVD, diabetes and/or obesity, or a combination thereof.

Because of their high specificity, the oligonucleotides herein specifically target mRNAs of target genes of cells, tissues, or organs (e.g., liver). In preventing disease, the target gene is the one that is required for initiation or maintenance of the disease or that has been identified as being associated with a higher risk of contracting the disease. In treating disease, one or more of the oligonucleotides herein are brought into contact with the cells, tissue or organ exhibiting or responsible for mediating the disease. For example, an oligonucleotide substantially complimentary to all or part of a wild-type (i.e., native) or mutated gene associated with a disease, disorder, or condition associated with SCAP activity is brought into contact with or introduced into a cell or tissue type of interest such as a hepatocyte or other liver cell.

In some embodiments, the target gene is from any mammal, such as a human. Any gene may be silenced according to the methods herein. Moreover, the methods herein typically involve administering to an individual a therapeutically effective amount of one or more oligonucleotides herein, that is, an amount capable of producing a desirable therapeutic result. The therapeutically acceptable amount is an amount that therapeutically treats a disease or disorder or condition. The appropriate dosage for any one individual will depend on certain factors, including the individual's size, body surface area, age, the composition to be administered, the active ingredient(s) in the composition, time and route of administration, general health, and other therapeutic agents being administered concurrently.

In the methods, the individual is administered any one of the oligonucleotides or compositions herein either enterally (e.g., orally, by gastric feeding tube, by duodenal feeding tube, via gastrostomy, or rectally), parenterally (e.g., subcutaneous injection, intravenous injection or infusion, intra-arterial injection or infusion, intraosseous infusion, intramuscular injection, intracerebral injection, intracerebroventricular injection, or intrathecal), topically (e.g., epicutaneous, inhalational, via eye drops, or through a mucous membrane), or by direct injection into a target organ (e.g., the liver of an individual). Typically, the oligonucleotides or compositions are administered intravenously or subcutaneously.

As a non-limiting set of examples, the oligonucleotides or compositions herein typically are administered quarterly (once every three months), bi-monthly (once every two months), monthly or weekly. For example, the oligonucleotides or compositions are administered every week or at intervals of two, or three weeks. In certain embodiments, the oligonucleotides, or compositions are administered daily. In some embodiments, an individual is administered one or more loading doses of the oligonucleotides or compositions followed by one or more maintenance doses of the oligonucleotides or compositions.

In some embodiments, the individual is a human, a NHP, or other mammal. In other embodiments, the individual is a domesticated animal such as a dog or a cats; livestock such as a horse, cattle, pig, sheep, goat, or chicken; and animals such as a mouse, rat, guinea pig or hamster.

III. Medical Uses: The oligonucleotides herein (e.g., a ds oligonucleotide such as a RNAi oligonucleotide) can be used, or adapted for use, to treat an individual (e.g., a human having a disease, disorder, or condition associated with SCAP activity) that would benefit from reducing SCAP activity. In some embodiments, the oligonucleotides are provided for use, or adapted for use, to treat an individual having a disease, disorder, or condition associated with SCAP activity. Also, the oligonucleotides are provided for use, or adaptable for use, in the manufacture of a medicament or pharmaceutical composition for treating a disease, disorder, or condition associated with SCAP activity. In other embodiments, the oligonucleotides are provided for use, or adaptable for use, in targeting SCAP mRNA and reducing SCAP activity (e.g., via the RNAi pathway). In other embodiments, the oligonucleotides are provided for use, or adaptable for use, in targeting SCAP mRNA and reducing an amount or level of SCAP mRNA, SCAP protein, and/or SCAP activity (i.e., reducing SCAP activity).

In some embodiments, the methods comprise selecting an individual for treatment based upon the individual having a marker (e.g., a biomarker) for a disease, disorder, or condition associated with SCAP activity, or someone predisposed to the same, such as, but not limited to, SCAP mRNA, SCAP protein, SCAP activity, or a combination thereof. Likewise, and as detailed below, the methods also comprise additional steps such as, for example, measuring or obtaining a baseline value for a marker of SCAP activity (e.g., SCAP protein or other biomarker) and then comparing such obtained value to one or more other baseline values or values obtained after the individual is administered one or more of the oligonucleotides to assess the effectiveness of treatment.

EXAMPLES

The following non-limiting examples are offered for purposes of illustration, not limitation.

Synthesis of Oligonucleotides

Example 1: Preparing ds RNAi Oligonucleotides

Oligonucleotide synthesizing and purifying: ds RNAi oligonucleotides in the Examples are chemically synthesized using methods described herein. Generally, ds RNAi oligonucleotides are synthesized using solid phase oligonucleotide synthesis methods as described for 19-23mer siRNAs (see, e.g., Scaringe et al. (1990) Nucleic Acids Res. 18:5433-41 and Usman et al. (1987) J. Am. Chem. Soc. 109:7845-45; see also, U.S. Pat. Nos. 5,804,683; 5,831,071; 5,998,203; 6,008,400; 6,111,086; 6,117,657; 6,353,098; 6,362,323; 6,437,117 and 6,469,158).

Individual RNA strands are synthesized and HPLC purified according to standard methods (Integrated DNA Technologies). For example, RNA oligonucleotides are synthesized using solid phase phosphoramidite chemistry, deprotected, and desalted on NAP-5 columns (Amersham Pharmacia Biotech; Piscataway, NJ) using standard techniques (Damha & Olgivie (1993) Methods Mol. Biol. 20:81-114; Wincott et al. (1995) Nucleic Acids Res. 23:2677-84). The oligomers are purified using ion-exchange high performance liquid chromatography (IE-HPLC) on an Amersham Source 15Q column (1.0 cm×25 cm; Amersham Pharmacia Biotech) using a 15 min step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples are monitored at 260 nm and peaks corresponding to the full-length oligonucleotide species are collected, pooled, desalted on NAP-5 columns, and lyophilized.

The purity of each oligomer is determined by capillary electrophoresis (CE) on a Beckman PACE 5000 (Beckman Coulter, Inc.). The CE capillaries have a 100 μm inner diameter and contain ssDNA 100R Gel (Beckman-Coulter). Typically, about 0.6 nmole of oligonucleotide is injected into a capillary, is run in an electric field of 444 V/cm and is detected by UV absorbance at 260 nm. Denaturing Tris-Borate-7 M-urea running buffer is purchased from Beckman-Coulter. Oligoribonucleotides are obtained that are at least 90% pure as assessed by CE for use in experiments described below. Compound identity is verified by matrix-assisted laser desorption ionization time-of-flight (MALDI-TOF) mass spectroscopy on a Voyager DE™ Biospectometry Work Station (Applied Biosystems) following the manufacturer's recommended protocol. Relative molecular masses of all oligomers are obtained, often within 0.2% of expected molecular mass.

Preparing duplexes: ss RNA oligomers are resuspended (e.g., at 100 μM concentration) in duplex buffer having 100 mM potassium acetate, 30 mM HEPES, pH 7.5. Complementary sense and antisense strands are mixed in equal molar amounts to yield a final solution of, for example, 50 μM duplex. Samples are heated to 100° C. for 5 min in RNA buffer (IDT) and are allowed to cool to room temperature before use. The ds RNA oligonucleotides are stored at −20° C. ss RNA oligomers are stored lyophilized or in nuclease-free water at −80° C.

In Vitro Function

Example 2: RNAi Oligonucleotide Modulation of SCAP Activity In Vitro—DsiRNA-Based Compounds SCAP target sequence identifying: To identify RNAi oligonucleotide inhibitors of SCAP expression, a computer-based algorithm is used to computationally generate SCAP target sequences suitable for assaying SCAP expression inhibition by the RNAi pathway. The algorithm provides RNAi oligonucleotide antisense strand sequences that are complementary to suitable SCAP target sequences of human SCAP mRNA (e.g., SEQ ID NO:1). Some of the antisense strand sequences identified by the algorithm also are complementary to the corresponding SCAP target sequence of mouse and NHP SCAP mRNA (e.g., SEQ ID NOs: 3 and 7, respectively). From this, 192 ds RNAi oligonucleotides (formatted as DsiRNA oligonucleotides) are generated, each with a unique antisense strand having a region of complementarity to a SCAP target sequence identified by the algorithm.

In vitro cell-based assays: The ability of each of the 192 DsiRNAs to inhibit SCAP expression is determined via in vitro cell-based assays. Further, and as shown herein, the nucleotide sequences for the sense strand and antisense strand of the DsiRNAs have a distinct pattern of modified nucleotides and phosphorothioate linkages. Briefly, Huh7 cells stably expressing SCAP are transfected with each of the DsiRNAs (1.0 nM) in separate wells of a multi-well cell culture plate. Cells are maintained for 24 hr following transfection, and then levels of remaining SCAP mRNA from the transfected cells are determined using TAQMAN®-based qPCR assays. Two qPCR assays, a 3' assay and a 5' assay, are used to determine mRNA levels as measured by HEX probes (e.g., Hs HPRT-517-591 and Hs SFRS9-569-712).

The results of the Huh7 cell-based assay with the 192 DsiRNAs are shown in Table 1, where the 192 DsiRNAs have antisense strands that are complementary to human, mouse and NHP SCAP mRNA ("triple-common") or that are complementary to human and NHP SCAP mRNA ("double-common"). Transfection of DsiRNA that results in less than or equal to 30% SCAP mRNA remaining in the cells when compared to negative controls is considered a candidate SCAP expression inhibitor (referred to herein as a "hit").

TABLE 1

Triple-Common and Double-Common DsiRNA SCAP mRNA Knockdown in Huh7 Cells, 1.0 nM 24 hr-5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| DsiRNA Oligo | % mRNA Remaining | % SEM | % mRNA Remaining | % SEM | % mRNA Remaining | % SEM |
| 1* | 107.4 | 21.4 | 106.0 | 23.5 | 106.7 | 1.0 |
| 2* | 68.9 | 10.1 | 52.8 | 6.2 | 60.9 | 11.4 |
| 3* | 46.4 | 5.0 | 39.5 | 4.7 | 42.9 | 4.9 |
| 4* | 93.2 | 8.5 | 72.0 | 9.6 | 82.6 | 15.0 |
| 5* | 89.3 | 14.2 | 69.2 | 15.6 | 79.2 | 14.2 |
| 6* | 115.4 | 17.5 | 115.4 | 8.0 | 115.4 | 0.0 |
| 7* | 80.3 | 6.4 | 76.4 | 5.8 | 78.4 | 2.8 |
| 8* | 131.0 | 17.9 | 126.5 | 9.7 | 128.8 | 3.2 |
| 9* | 46.8 | 12.7 | 42.3 | 11.1 | 44.6 | 3.2 |
| 10* | 55.4 | 6.7 | 53.2 | 5.4 | 54.3 | 1.6 |
| 11* | 150.4 | 10.7 | 125.7 | 9.2 | 138.1 | 17.5 |
| 12* | 124.7 | 34.5 | 122.0 | 31.5 | 123.4 | 1.9 |
| 13* | 47.8 | 9.7 | 47.8 | 6.0 | 47.8 | 0.0 |
| 14* | 118.5 | 61.1 | 132.8 | 62.8 | 125.6 | 10.1 |
| 15* | 126.7 | 13.6 | 125.4 | 12.5 | 126.0 | 0.9 |
| 16* | 87.3 | 15.4 | 91.4 | 15.7 | 89.3 | 2.9 |
| 17* | 107.4 | 13.6 | 105.4 | 11.8 | 106.4 | 1.4 |
| 18* | 132.1 | 8.8 | 133.6 | 12.2 | 132.8 | 1.1 |
| 19* | 121.1 | 24.3 | 109.8 | 23.5 | 115.4 | 8.0 |
| 20* | 30.5 | 6.2 | 36.1 | 8.3 | 33.3 | 3.9 |
| 21* | 34.4 | 5.0 | 42.4 | 4.4 | 38.4 | 5.7 |
| 22* | 59.7 | 7.7 | 67.7 | 6.8 | 63.7 | 5.6 |
| 23* | 106.6 | 10.5 | 111.8 | 9.8 | 109.2 | 3.7 |
| 24* | 10.5 | 3.5 | 9.1 | 4.4 | 9.8 | 1.0 |
| 25* | 246.5 | 29.4 | 152.6 | 23.9 | 199.6 | 66.4 |
| 26* | 52.0 | 4.5 | 41.1 | 4.5 | 46.5 | 7.7 |
| 27* | 222.2 | 49.6 | 175.3 | 31.2 | 198.8 | 33.2 |
| 28* | 207.2 | 57.5 | 156.9 | 39.5 | 182.0 | 35.6 |
| 29* | 102.7 | 7.3 | 96.0 | 4.8 | 99.4 | 4.7 |
| 30* | 62.1 | 7.1 | 70.3 | 12.4 | 66.2 | 5.8 |

TABLE 1-continued

Triple-Common and Double-Common DsiRNA SCAP mRNA Knockdown in Huh7 Cells, 1.0 nM 24 hr-5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| DsiRNA Oligo | % mRNA Remaining | % SEM | % mRNA Remaining | % SEM | % mRNA Remaining | % SEM |
| 31* | 157.0 | 25.1 | 121.6 | 19.7 | 139.3 | 25.0 |
| 32* | 129.3 | 59.1 | 131.1 | 36.6 | 130.2 | 1.3 |
| 33* | 28.1 | 4.4 | 24.0 | 3.4 | 26.1 | 2.9 |
| 34* | 152.3 | 77.3 | 166.5 | 76.4 | 159.4 | 10.0 |
| 35* | 129.4 | 21.7 | 124.1 | 16.7 | 126.7 | 3.8 |
| 36* | 90.1 | 17.6 | 89.9 | 16.3 | 90.0 | 0.1 |
| 37* | 111.7 | 40.0 | 111.5 | 30.2 | 111.6 | 0.2 |
| 38* | 66.9 | 11.5 | 73.6 | 12.5 | 70.2 | 4.7 |
| 39* | 122.1 | 24.4 | 123.0 | 24.7 | 122.6 | 0.6 |
| 40* | 100.7 | 11.1 | 93.5 | 15.4 | 97.1 | 5.1 |
| 41* | 54.0 | 6.9 | 54.0 | 7.9 | 54.0 | 0.0 |
| 42* | 29.3 | 12.8 | 39.4 | 14.5 | 34.3 | 7.1 |
| 43* | 21.0 | 6.1 | 18.2 | 5.5 | 19.6 | 1.9 |
| 44* | 25.5 | 5.1 | 29.8 | 6.3 | 27.6 | 3.0 |
| 45* | 81.3 | 39.1 | 89.7 | 47.4 | 85.5 | 6.0 |
| 46* | 73.8 | 23.5 | 83.3 | 25.4 | 78.5 | 6.7 |
| 47* | 89.6 | 31.0 | 96.1 | 37.1 | 92.9 | 4.6 |
| 48* | 86.4 | 34.3 | 87.6 | 37.9 | 87.0 | 0.8 |
| 49 | 40.9 | 7.0 | 33.8 | 5.5 | 37.3 | 5.0 |
| 50 | 131.1 | 15.2 | 102.5 | 12.7 | 116.8 | 20.2 |
| 51 | 62.6 | 28.3 | 52.6 | 24.2 | 57.6 | 7.1 |
| 52 | 44.0 | 4.8 | 45.3 | 5.4 | 44.6 | 0.9 |
| 53 | 46.5 | 9.0 | 50.6 | 9.9 | 48.6 | 2.9 |
| 54 | 57.5 | 5.0 | 58.5 | 4.8 | 58.0 | 0.7 |
| 55 | 58.7 | 7.7 | 63.2 | 10.2 | 61.0 | 3.2 |
| 56 | 74.2 | 14.3 | 60.2 | 13.8 | 67.2 | 9.9 |
| 57 | 28.8 | 4.3 | 24.5 | 3.0 | 26.6 | 3.0 |
| 58 | 87.5 | 9.6 | 82.0 | 8.8 | 84.7 | 3.9 |
| 59 | 117.5 | 28.7 | 123.7 | 27.6 | 120.6 | 4.4 |
| 60 | 59.3 | 12.1 | 51.5 | 9.5 | 55.4 | 5.5 |
| 61 | 40.5 | 11.0 | 39.4 | 8.6 | 39.9 | 0.8 |
| 62 | 56.0 | 26.9 | 64.0 | 29.2 | 60.0 | 5.7 |
| 63 | 41.1 | 6.3 | 43.3 | 6.7 | 42.2 | 1.5 |
| 64 | 29.9 | 6.3 | 39.1 | 7.3 | 34.5 | 6.5 |
| 65 | 29.4 | 5.2 | 28.1 | 4.6 | 28.8 | 0.9 |
| 66 | 29.3 | 5.6 | 27.8 | 5.5 | 28.6 | 1.1 |
| 67 | 41.6 | 24.9 | 41.7 | 22.6 | 41.6 | 0.1 |
| 68 | 59.5 | 8.6 | 60.2 | 7.3 | 59.8 | 0.5 |
| 69 | 33.4 | 6.7 | 37.9 | 7.3 | 35.7 | 3.2 |
| 70 | 16.0 | 3.9 | 17.1 | 4.3 | 16.6 | 0.8 |
| 71 | 111.7 | 22.9 | 105.5 | 21.7 | 108.6 | 4.4 |
| 72 | 88.8 | 48.5 | 45.9 | 30.6 | 67.4 | 30.3 |
| 73 | 34.4 | 7.9 | 37.9 | 8.5 | 36.2 | 2.5 |
| 74 | 129.9 | 11.4 | 113.4 | 11.4 | 121.6 | 11.6 |
| 75 | 64.9 | 7.7 | 65.3 | 6.7 | 65.1 | 0.3 |
| 76 | 187.1 | 75.1 | — | — | 187.1 | 75.1 |
| 77 | 218.5 | 65.1 | — | — | 218.5 | 65.1 |
| 78 | 98.7 | 7.9 | 98.8 | 6.7 | 98.8 | 0.1 |
| 79 | 31.8 | 15.2 | 62.2 | 18.1 | 47.0 | 21.6 |
| 80 | 161.4 | 27.9 | 149.7 | 26.5 | 155.6 | 8.3 |
| 81 | 68.5 | 5.4 | 65.2 | 3.9 | 66.9 | 2.4 |
| 82 | 71.5 | 4.9 | 70.0 | 5.0 | 70.8 | 1.0 |
| 83 | 111.5 | 8.3 | 103.3 | 6.8 | 107.4 | 5.8 |
| 84 | 76.0 | 4.1 | 73.1 | 3.6 | 74.5 | 2.1 |
| 85 | 93.6 | 9.8 | 94.7 | 11.5 | 94.1 | 0.7 |
| 86 | 78.3 | 11.1 | 83.3 | 12.0 | 80.8 | 3.5 |
| 87 | 100.8 | 13.4 | 95.3 | 12.6 | 98.1 | 3.9 |
| 88 | 114.1 | 42.1 | 167.9 | 40.7 | 141.0 | 38.0 |
| 89 | 35.2 | 3.6 | 39.7 | 4.6 | 37.4 | 3.2 |
| 90 | 62.8 | 7.7 | 59.1 | 6.1 | 61.0 | 2.6 |
| 91 | 95.4 | 9.1 | 76.2 | 6.8 | 85.8 | 13.6 |
| 92 | 149.2 | 11.9 | 111.5 | 12.5 | 130.4 | 26.7 |
| 93 | 61.1 | 7.4 | 54.1 | 7.5 | 57.6 | 5.0 |
| 94 | 78.7 | 7.0 | 82.0 | 7.2 | 80.4 | 2.3 |
| 95 | 67.0 | 10.3 | 62.0 | 9.6 | 64.5 | 3.5 |
| 96 | 51.1 | 5.2 | 52.1 | 4.2 | 51.6 | 0.7 |
| 97 | 103.5 | 16.2 | 97.9 | 20.3 | 100.7 | 3.9 |
| 98 | 83.0 | 7.7 | 81.6 | 6.1 | 82.3 | 1.0 |
| 99 | 103.2 | 12.4 | 98.9 | 11.6 | 101.0 | 3.0 |
| 100 | 90.9 | 22.9 | 116.3 | 28.3 | 103.6 | 18.0 |

TABLE 1-continued

Triple-Common and Double-Common DsiRNA SCAP mRNA Knockdown in Huh7 Cells, 1.0 nM 24 hr-5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| DsiRNA Oligo | % mRNA Remaining | % SEM | % mRNA Remaining | % SEM | % mRNA Remaining | % SEM |
| 101 | 44.4 | 12.9 | 35.9 | 9.7 | 40.1 | 6.0 |
| 102 | 70.1 | 7.3 | 78.0 | 9.6 | 74.0 | 5.5 |
| 103 | 41.6 | 10.9 | 35.8 | 11.0 | 38.7 | 4.1 |
| 104 | 25.2 | 7.6 | 29.7 | 9.3 | 27.5 | 3.2 |
| 105 | 31.5 | 4.7 | 33.1 | 4.8 | 32.3 | 1.1 |
| 106 | 20.4 | 4.3 | 23.5 | 4.6 | 21.9 | 2.2 |
| 107 | 20.4 | 1.5 | 21.8 | 2.4 | 21.1 | 1.0 |
| 108 | 28.4 | 6.6 | 30.6 | 5.2 | 29.5 | 1.5 |
| 109 | 40.1 | 3.3 | 42.2 | 3.7 | 41.1 | 1.5 |
| 110 | 34.9 | 3.7 | 35.7 | 3.8 | 35.3 | 0.5 |
| 111 | 89.0 | 5.5 | 85.6 | 6.0 | 87.3 | 2.4 |
| 112 | 54.3 | 5.4 | 54.5 | 7.7 | 54.4 | 0.2 |
| 113 | 30.5 | 2.0 | 32.6 | 2.1 | 31.6 | 1.5 |
| 114 | 51.3 | 3.3 | 64.5 | 4.2 | 57.9 | 9.3 |
| 115 | 33.9 | 2.4 | 36.5 | 2.6 | 35.2 | 1.8 |
| 116 | 86.1 | 6.6 | 94.7 | 7.1 | 90.4 | 6.1 |
| 117 | 29.5 | 3.8 | 35.5 | 2.4 | 32.5 | 4.2 |
| 118 | 74.0 | 8.6 | 81.1 | 6.3 | 77.6 | 5.1 |
| 119 | 33.3 | 2.7 | 37.5 | 3.2 | 35.4 | 3.0 |
| 120 | 19.3 | 2.2 | 20.1 | 3.0 | 19.7 | 0.6 |
| 121 | 42.7 | 8.0 | 39.7 | 5.4 | 41.2 | 2.1 |
| 122 | 78.4 | 14.0 | 70.7 | 12.2 | 74.5 | 5.5 |
| 123 | 34.1 | 3.6 | 32.2 | 4.4 | 33.1 | 1.3 |
| 124 | 59.9 | 7.0 | 66.0 | 6.9 | 62.9 | 4.3 |
| 125 | 64.1 | 7.9 | 59.2 | 7.2 | 61.6 | 3.4 |
| 126 | 127.6 | 23.1 | 148.6 | 19.6 | 138.1 | 14.9 |
| 127 | 152.4 | 26.3 | 139.9 | 20.1 | 146.1 | 8.8 |
| 128 | 209.1 | 65.6 | 150.9 | 44.7 | 180.0 | 41.2 |
| 129 | 91.9 | 9.2 | 78.7 | 7.3 | 85.3 | 9.3 |
| 130 | 91.0 | 17.5 | 88.2 | 20.2 | 89.6 | 2.0 |
| 131 | 54.3 | 5.3 | 52.7 | 3.6 | 53.5 | 1.1 |
| 132 | 68.1 | 6.5 | 59.3 | 4.5 | 63.7 | 6.2 |
| 133 | 36.1 | 5.5 | 33.3 | 4.2 | 34.7 | 2.0 |
| 134 | 83.3 | 17.0 | 73.3 | 17.0 | 78.3 | 7.1 |
| 135 | 68.8 | 4.9 | 64.7 | 4.2 | 66.8 | 2.9 |
| 136 | 43.4 | 8.7 | 48.5 | 9.2 | 45.9 | 3.6 |
| 137 | 61.4 | 7.4 | 59.2 | 5.0 | 60.3 | 1.6 |
| 138 | 54.5 | 6.1 | 60.9 | 5.6 | 57.7 | 4.6 |
| 139 | 87.3 | 5.7 | 83.2 | 6.4 | 85.2 | 2.9 |
| 140 | 89.9 | 5.4 | 90.7 | 6.0 | 90.3 | 0.6 |
| 141 | 57.1 | 4.7 | 55.2 | 3.4 | 56.2 | 1.3 |
| 142 | 53.8 | 5.0 | 56.3 | 7.2 | 55.1 | 1.8 |
| 143 | 81.6 | 8.7 | 77.9 | 9.2 | 79.7 | 2.6 |
| 144 | 23.6 | 4.2 | 22.9 | 3.1 | 23.3 | 0.5 |
| 145 | 51.5 | 16.2 | 37.3 | 11.8 | 44.4 | 10.1 |
| 146 | 79.5 | 14.9 | 66.8 | 19.5 | 73.2 | 9.0 |
| 147 | 143.6 | 14.6 | 109.5 | 14.5 | 126.6 | 24.1 |
| 148 | 119.3 | 64.0 | 74.8 | 47.1 | 97.0 | 31.4 |
| 149 | 117.9 | 48.3 | 65.1 | 23.6 | 91.5 | 37.3 |
| 150 | 224.2 | 88.9 | 112.2 | 58.1 | 168.2 | 79.2 |
| 151 | 284.8 | 174.5 | 162.4 | 86.4 | 223.6 | 86.6 |
| 152 | 82.4 | 35.3 | 76.6 | 39.1 | 79.5 | 4.1 |
| 153 | 54.4 | 7.8 | 45.0 | 9.0 | 49.7 | 6.7 |
| 154 | 112.6 | 20.0 | 102.3 | 14.6 | 107.4 | 7.3 |
| 155 | 115.3 | 17.1 | 88.6 | 10.9 | 102.0 | 18.9 |
| 156 | 53.1 | 6.1 | 42.5 | 4.3 | 47.8 | 7.5 |
| 157 | 36.7 | 5.4 | 32.7 | 3.4 | 34.7 | 2.9 |
| 158 | 42.9 | 11.3 | 41.7 | 9.6 | 42.3 | 0.9 |
| 159 | 33.2 | 5.0 | 34.0 | 3.6 | 33.6 | 0.6 |
| 160 | 113.5 | 11.4 | 102.3 | 9.4 | 107.9 | 7.9 |
| 161 | 69.4 | 10.0 | 70.5 | 8.1 | 69.9 | 0.8 |
| 162 | 58.2 | 6.6 | 51.1 | 6.3 | 54.6 | 5.1 |
| 163 | 21.3 | 3.8 | 14.8 | 4.0 | 18.0 | 4.6 |
| 164 | 23.1 | 4.0 | 17.7 | 2.9 | 20.4 | 3.8 |
| 165 | 13.5 | 1.7 | 9.7 | 1.7 | 11.6 | 2.7 |
| 166 | 29.2 | 4.6 | 28.4 | 4.2 | 28.8 | 0.6 |
| 167 | 83.1 | 7.6 | 84.0 | 7.6 | 83.5 | 0.6 |
| 168 | 85.7 | 25.3 | 91.5 | 26.7 | 88.6 | 4.1 |
| 169 | 122.6 | 8.8 | 91.3 | 13.8 | 106.9 | 22.2 |
| 170 | 134.4 | 11.8 | 95.4 | 8.0 | 114.9 | 27.6 |

TABLE 1-continued

Triple-Common and Double-Common DsiRNA SCAP mRNA Knockdown in Huh7 Cells, 1.0 nM 24 hr-5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| DsiRNA Oligo | % mRNA Remaining | % SEM | % mRNA Remaining | % SEM | % mRNA Remaining | % SEM |
| 171 | 74.5 | 8.0 | 52.5 | 9.2 | 63.5 | 15.6 |
| 172 | 194.8 | 20.1 | 158.8 | 18.1 | 176.8 | 25.5 |
| 173 | 168.6 | 16.7 | 162.7 | 18.0 | 165.7 | 4.2 |
| 174 | 37.0 | 6.5 | 47.8 | 9.7 | 42.4 | 7.6 |
| 175 | 60.3 | 40.8 | 46.6 | 44.7 | 53.4 | 9.7 |
| 176 | 19.5 | 2.7 | 21.0 | 2.9 | 20.3 | 1.1 |
| 177 | 28.7 | 2.2 | 23.3 | 2.4 | 26.0 | 3.8 |
| 178 | 38.1 | 3.4 | 35.8 | 4.1 | 36.9 | 1.7 |
| 179 | 61.3 | 5.4 | 55.3 | 3.4 | 58.3 | 4.2 |
| 180 | 152.9 | 13.8 | 118.6 | 10.4 | 135.8 | 24.3 |
| 181 | 68.4 | 7.8 | 69.5 | 8.1 | 68.9 | 0.8 |
| 182 | 57.6 | 6.2 | 58.9 | 5.8 | 58.2 | 0.9 |
| 183 | 127.1 | 9.9 | 126.5 | 10.5 | 126.8 | 0.4 |
| 184 | 102.8 | 11.1 | 107.8 | 11.5 | 105.3 | 3.6 |
| 185 | 106.6 | 9.0 | 94.7 | 8.2 | 100.7 | 8.4 |
| 186 | 54.5 | 28.0 | 49.0 | 25.2 | 51.8 | 3.9 |
| 187 | 112.8 | 9.1 | 85.6 | 11.3 | 99.2 | 19.2 |
| 188 | 70.6 | 6.3 | 72.5 | 7.3 | 71.6 | 1.4 |
| 189 | 50.2 | 4.5 | 50.0 | 5.1 | 50.1 | 0.1 |
| 190 | 115.9 | 9.8 | 130.3 | 9.9 | 123.1 | 10.2 |
| 191 | 102.7 | 13.1 | 103.6 | 6.4 | 103.2 | 0.6 |
| 192 | 83.3 | 18.9 | 74.9 | 19.8 | 79.1 | 5.9 |

NOTE:
*denotes triple-common.

Additionally, primary human hepatocytes, such as 3D spheroids, are transfected with each of the DsiRNAs (100 nM) in separate wells of a multi-well cell culture plate. Cells are maintained for 7 days following transfection, and then levels of remaining SCAP mRNA from the transfected cells are determined using TAQMAN®-based qPCR assays. Two qPCR assays, a 3' assay and a 5' assay, are used to determine mRNA levels as measured by HEX probes (e.g., Hs HPRT-517-591 and Hs SFRS9-569-712).

The results of the human hepatocyte 3D spheroid-based assay with the DsiRNAs are shown in Table 2. As above, transfection of a DsiRNA that results in less than or equal to 30% SCAP mRNA remaining in the cells when compared to negative controls is considered a candidate SCAP expression inhibitor (referred to herein as a "hit").

TABLE 2

Triple-Common and Double-Common DsiRNA SCAP mRNA Knockdown in 3D Human Spheroids, 100 nM 7 days-5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| DsiRNA Oligo | % mRNA Remaining | % SEM | % mRNA Remaining | % SEM | % mRNA Remaining | % SEM |
| 1* | 67.3 | 11.5 | 66.3 | 12.0 | 66.8 | 0.7 |
| 2* | 26.3 | 12.1 | 17.7 | 7.8 | 22.0 | 6.1 |
| 3* | 43.5 | 4.7 | 48.0 | 5.6 | 45.7 | 3.2 |
| 4* | 64.2 | 12.4 | 55.8 | 13.6 | 60.0 | 6.0 |
| 5* | 73.5 | 10.2 | 86.3 | 11.0 | 79.9 | 9.0 |
| 6* | 59.8 | 10.1 | 94.1 | 11.3 | 77.0 | 24.3 |
| 7* | 43.9 | 7.8 | 60.8 | 11.1 | 52.3 | 11.9 |
| 8* | 94.4 | 26.7 | 110.7 | 19.3 | 102.6 | 11.5 |
| 9* | 32.7 | 5.0 | 53.7 | 10.3 | 43.2 | 14.8 |
| 10* | 44.1 | 3.3 | 61.7 | 5.1 | 52.9 | 12.4 |
| 11* | 77.1 | 21.9 | 97.5 | 18.5 | 87.3 | 14.4 |

TABLE 2-continued

Triple-Common and Double-Common DsiRNA SCAP mRNA Knockdown in 3D Human Spheroids, 100 nM 7 days-5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| DsiRNA Oligo | % mRNA Remaining | % SEM | % mRNA Remaining | % SEM | % mRNA Remaining | % SEM |
| 12* | 64.3 | 54.4 | 72.5 | 53.6 | 68.4 | 5.8 |
| 13* | 6.4 | 1.9 | 36.3 | 6.9 | 21.4 | 21.1 |
| 14* | 80.4 | 16.1 | 104.2 | 17.8 | 92.3 | 16.8 |
| 15* | 87.1 | 10.4 | 111.2 | 12.5 | 99.2 | 17.0 |
| 16* | 91.3 | 19.6 | 106.5 | 23.2 | 98.9 | 10.8 |
| 17* | 64.3 | 6.3 | 101.3 | 14.1 | 82.8 | 26.2 |
| 18* | 99.0 | 18.7 | 101.6 | 28.4 | 100.3 | 1.8 |
| 19* | 75.7 | 11.1 | 90.1 | 16.0 | 82.9 | 10.2 |
| 20* | 35.2 | 7.4 | 45.6 | 12.1 | 40.4 | 7.3 |
| 21* | 32.7 | 7.0 | 35.0 | 11.0 | 33.9 | 1.6 |
| 22* | 49.3 | 4.8 | 61.6 | 5.2 | 55.4 | 8.7 |
| 23* | 76.2 | 16.4 | 86.0 | 20.5 | 81.1 | 6.9 |
| 24* | 22.7 | 4.6 | 38.0 | 7.1 | 30.4 | 10.8 |
| 25* | 110.6 | 19.0 | 103.6 | 19.7 | 107.1 | 4.9 |
| 26* | 57.2 | 16.0 | 67.9 | 16.1 | 62.6 | 7.6 |
| 27* | 66.4 | 11.2 | 78.6 | 11.9 | 72.5 | 8.6 |
| 28* | 100.0 | 22.1 | 134.8 | 21.6 | 117.4 | 24.6 |
| 29* | 53.2 | 13.3 | 58.1 | 13.8 | 55.6 | 3.5 |
| 30* | 42.7 | 10.6 | 66.5 | 15.3 | 54.6 | 16.8 |
| 31* | 46.2 | 5.8 | 89.9 | 12.6 | 68.0 | 31.0 |
| 32* | 59.9 | 12.1 | 73.3 | 11.8 | 66.6 | 9.5 |
| 33* | 29.4 | 5.5 | 38.5 | 7.4 | 33.9 | 6.4 |
| 34* | 92.3 | 19.3 | 127.0 | 18.3 | 109.7 | 24.6 |
| 35* | 95.5 | 25.6 | 120.3 | 27.5 | 107.9 | 17.5 |
| 36* | 69.9 | 20.9 | 102.1 | 33.2 | 86.0 | 22.8 |
| 37* | 57.1 | 20.6 | 82.3 | 22.0 | 69.7 | 17.8 |
| 38* | 53.7 | 12.9 | 70.4 | 14.8 | 62.1 | 11.8 |
| 39* | 87.5 | 19.1 | 107.1 | 26.1 | 97.3 | 13.8 |
| 40* | 67.7 | 16.2 | 93.7 | 26.9 | 80.7 | 18.4 |
| 41* | 78.5 | 16.1 | 94.7 | 14.0 | 86.6 | 11.5 |
| 42* | 43.0 | 5.8 | 39.2 | 5.7 | 41.1 | 2.7 |
| 43* | 25.8 | 4.7 | 29.7 | 5.4 | 27.7 | 2.8 |
| 44* | 55.4 | 7.6 | 72.2 | 8.6 | 63.8 | 11.9 |
| 45* | 78.0 | 7.7 | 101.9 | 7.2 | 89.9 | 16.9 |
| 46* | 53.4 | 38.0 | 118.6 | 56.2 | 86.0 | 46.1 |
| 47* | 69.1 | 10.8 | 87.4 | 13.8 | 78.2 | 12.9 |
| 48* | 155.7 | 107.9 | 73.6 | 57.4 | 114.7 | 58.0 |
| 49 | 57.1 | 9.2 | 62.7 | 11.9 | 59.9 | 3.9 |
| 50 | 61.2 | 6.3 | 76.6 | 7.7 | 68.9 | 10.9 |
| 51 | 37.8 | 6.3 | 38.1 | 7.6 | 38.0 | 0.2 |
| 52 | 32.6 | 5.7 | 35.9 | 8.4 | 34.2 | 2.3 |
| 53 | 50.4 | 3.8 | 60.5 | 6.5 | 55.4 | 7.1 |
| 54 | 41.8 | 9.4 | 51.4 | 12.0 | 46.6 | 6.8 |
| 55 | 58.5 | 8.0 | 57.5 | 11.4 | 58.0 | 0.7 |
| 56 | 82.7 | 14.0 | 86.3 | 17.9 | 84.5 | 2.5 |
| 57 | 59.9 | 5.9 | 64.3 | 5.5 | 62.1 | 3.1 |
| 58 | 90.3 | 11.2 | 87.7 | 10.9 | 89.0 | 1.9 |
| 59 | 78.7 | 8.1 | 83.8 | 7.3 | 81.3 | 3.6 |
| 60 | 40.2 | 8.8 | 35.7 | 8.0 | 37.9 | 3.2 |
| 61 | 46.5 | 8.6 | 49.6 | 8.7 | 48.1 | 2.2 |
| 62 | 33.4 | 6.5 | 38.3 | 7.2 | 35.9 | 3.5 |
| 63 | 30.7 | 5.0 | 41.2 | 6.5 | 36.0 | 7.4 |
| 64 | 60.0 | 11.9 | 48.1 | 9.6 | 54.1 | 8.4 |
| 65 | 39.0 | 5.5 | 39.0 | 6.1 | 39.0 | 0.1 |
| 66 | 30.3 | 3.4 | 25.6 | 3.6 | 28.0 | 3.3 |
| 67 | 14.2 | 3.6 | 17.0 | 3.7 | 15.6 | 1.9 |
| 68 | 33.4 | 5.2 | 28.6 | 5.2 | 31.0 | 3.4 |
| 69 | 27.9 | 1.9 | 32.7 | 4.3 | 30.3 | 3.4 |
| 70 | 11.0 | 1.2 | 12.4 | 1.7 | 11.7 | 1.0 |
| 71 | 74.5 | 6.9 | 87.7 | 7.5 | 81.1 | 9.3 |
| 72 | 88.7 | 7.1 | 83.0 | 7.8 | 85.8 | 4.1 |
| 73 | 41.3 | 12.4 | 46.3 | 5.4 | 43.8 | 3.5 |
| 74 | 77.9 | 28.7 | 99.8 | 29.7 | 88.9 | 15.4 |
| 75 | 45.8 | 20.7 | 86.2 | 21.2 | 66.0 | 28.6 |
| 76 | 81.9 | 13.4 | 86.9 | 15.8 | 84.4 | 3.5 |
| 77 | 94.3 | 14.9 | 105.8 | 13.8 | 100.0 | 8.2 |
| 78 | 73.6 | 10.1 | 84.8 | 12.6 | 79.2 | 7.9 |
| 79 | 41.2 | 8.6 | 47.3 | 9.2 | 44.2 | 4.3 |
| 80 | 68.6 | 6.7 | 91.5 | 8.5 | 80.0 | 16.2 |

TABLE 2-continued

Triple-Common and Double-Common DsiRNA SCAP mRNA Knockdown in 3D Human Spheroids, 100 nM 7 days-5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| DsiRNA Oligo | % mRNA Remaining | % SEM | % mRNA Remaining | % SEM | % mRNA Remaining | % SEM |
| 81 | 60.5 | 5.8 | 67.7 | 10.2 | 64.1 | 5.1 |
| 82 | 49.4 | 21.3 | 49.5 | 12.3 | 49.5 | 0.1 |
| 83 | 65.4 | 7.3 | 85.3 | 10.4 | 75.4 | 14.1 |
| 84 | 66.2 | 10.2 | 60.9 | 11.2 | 63.5 | 3.8 |
| 85 | 67.7 | 4.9 | 78.3 | 6.6 | 73.0 | 7.5 |
| 86 | 58.2 | 7.3 | 71.3 | 9.5 | 64.7 | 9.3 |
| 87 | 66.2 | 4.9 | 79.2 | 8.8 | 72.7 | 9.2 |
| 88 | 82.1 | 11.0 | 94.1 | 15.9 | 88.1 | 8.5 |
| 89 | 83.4 | 56.0 | 48.4 | 20.8 | 65.9 | 24.8 |
| 90 | 67.7 | 9.7 | 67.3 | 9.1 | 67.5 | 0.3 |
| 91 | 56.9 | 23.8 | 55.5 | 22.0 | 56.2 | 1.0 |
| 92 | 83.5 | 8.7 | 84.2 | 9.2 | 83.9 | 0.4 |
| 93 | 49.2 | 4.3 | 45.6 | 5.4 | 47.4 | 2.5 |
| 94 | 62.6 | 6.2 | 79.6 | 9.5 | 71.1 | 12. |
| 95 | 43.8 | 9.1 | 48.4 | 10.3 | 46.1 | 3.2 |
| 96 | 47.6 | 6.8 | 48.7 | 6.1 | 48.1 | 0.7 |
| 97 | 127.0 | 110.9 | 66.2 | 54.3 | 96.6 | 43.0 |
| 98 | 56.9 | 5.5 | 68.5 | 5.4 | 62.7 | 8.2 |
| 99 | 83.0 | 6.1 | 84.6 | 9.6 | 83.8 | 1.1 |
| 100 | 72.1 | 25.4 | 137.4 | 41.3 | 104.7 | 46.2 |
| 101 | 39.0 | 6.9 | 48.5 | 9.0 | 43.8 | 6.7 |
| 102 | 55.8 | 6.4 | 74.0 | 10.7 | 64.9 | 12.9 |
| 103 | 21.6 | 10.5 | 41.7 | 15.9 | 31.6 | 14.2 |
| 104 | 12.6 | 7.3 | 15.9 | 11.4 | 14.2 | 2.3 |
| 105 | 17.6 | 3.1 | 60.0 | 6.8 | 38.8 | 30.0 |
| 106 | 3.3 | 0.6 | 13.9 | 5.1 | 8.6 | 7.5 |
| 107 | 6.4 | 1.5 | 22.9 | 5.2 | 14.7 | 11.7 |
| 108 | 17.7 | 2.9 | 44.6 | 8.3 | 31.1 | 19.1 |
| 109 | 15.8 | 10.0 | 57.0 | 30.9 | 36.4 | 29.2 |
| 110 | 12.1 | 1.4 | 49.2 | 5.2 | 30.6 | 26.2 |
| 111 | 27.8 | 6.9 | 50.5 | 12.1 | 39.2 | 16.1 |
| 112 | 28.8 | 15.5 | 64.5 | 27.3 | 46.7 | 25.2 |
| 113 | 20.7 | 3.0 | 40.6 | 5.4 | 30.6 | 14.1 |
| 114 | 37.7 | 17.1 | 71.2 | 22.6 | 54.4 | 23.7 |
| 115 | 17.5 | 6.2 | 30.2 | 11.8 | 23.9 | 9.0 |
| 116 | 63.9 | 9.2 | 86.9 | 11.8 | 75.4 | 16.3 |
| 117 | 30.5 | 2.9 | 39.4 | 4.1 | 34.9 | 6.3 |
| 118 | 43.9 | 10.9 | 61.8 | 14.2 | 52.9 | 12.7 |
| 119 | 44.0 | 5.2 | 57.4 | 8.7 | 50.7 | 9.5 |
| 120 | 38.1 | 12.1 | 55.8 | 15.3 | 46.9 | 12.5 |
| 121 | 59.4 | 29.3 | 86.1 | 35.7 | 72.8 | 18.9 |
| 122 | 62.6 | 12.2 | 81.9 | 13.3 | 72.3 | 13.7 |
| 123 | 55.7 | 19.8 | 85.2 | 30.5 | 70.5 | 20.8 |
| 124 | 35.2 | 8.0 | 80.9 | 21.6 | 58.1 | 32.4 |
| 125 | 57.3 | 8.2 | 71.1 | 7.1 | 64.2 | 9.7 |
| 126 | 86.3 | 21.0 | 88.9 | 25.2 | 87.6 | 1.8 |
| 127 | 83.4 | 15.4 | 106.5 | 22.9 | 94.9 | 16.3 |
| 128 | 119.6 | 61.8 | 78.2 | 59.0 | 98.9 | 29.3 |
| 129 | 88.0 | 14.9 | 94.3 | 16.8 | 91.2 | 4.4 |
| 130 | 94.3 | 68.0 | 83.8 | 54.1 | 89.1 | 7.5 |
| 131 | 50.2 | 17.0 | 66.4 | 14.8 | 58.3 | 11.5 |
| 132 | 50.9 | 5.1 | 47.6 | 4.6 | 49.3 | 2.4 |
| 133 | 33.1 | 18.1 | 45.3 | 13.4 | 39.2 | 8.6 |
| 134 | 38.7 | 21.1 | 61.9 | 25.4 | 50.3 | 16.4 |
| 135 | — | — | 52.6 | 31.5 | 52.6 | 31.5 |
| 136 | 34.2 | 10.0 | 37.6 | 10.1 | 35.9 | 2.4 |
| 137 | 92.8 | 24.3 | 92.7 | 21.9 | 92.8 | 0.1 |
| 138 | 49.7 | 14.6 | 48.9 | 11.4 | 49.3 | 0.6 |
| 139 | 74.2 | 11.0 | 86.8 | 11.9 | 80.5 | 8.9 |
| 140 | 91.6 | 25.4 | 92.3 | 27.1 | 91.9 | 0.5 |
| 141 | 61.9 | 7.5 | 64.1 | 8.2 | 63.0 | 1.6 |
| 142 | 60.3 | 10.8 | 72.7 | 17.4 | 66.5 | 8.8 |
| 143 | 136.6 | 56.4 | 55.2 | 41.9 | 95.9 | 57.6 |
| 144 | 121.2 | 42.0 | 59.0 | 29.7 | 90.1 | 44.0 |
| 145 | 83.5 | 10.9 | 87.6 | 12.3 | 85.5 | 2.9 |
| 146 | 73.6 | 7.3 | 67.9 | 4.9 | 70.7 | 4.0 |
| 147 | 104.3 | 16.4 | 77.3 | 8.5 | 90.8 | 19.1 |
| 148 | 84.2 | 12.7 | 81.0 | 10.8 | 82.6 | 2.3 |
| 149 | 53.4 | 9.7 | 58.5 | 11.8 | 55.9 | 3.6 |
| 150 | 77.3 | 25.8 | 69.8 | 23.9 | 73.5 | 5.4 |
| 151 | 108.2 | 43.9 | 120.3 | 39.8 | 114.3 | 8.5 |
| 152 | 66.5 | 12.1 | 56.5 | 11.2 | 61.5 | 7.1 |
| 153 | 43.3 | 6.4 | 57.9 | 11.6 | 50.6 | 10.4 |
| 154 | 78.7 | 8.2 | 78.4 | 9.0 | 78.5 | 0.2 |
| 155 | 86.6 | 8.1 | 69.9 | 7.7 | 78.3 | 11.8 |
| 156 | 36.0 | 4.9 | 40.7 | 4.3 | 38.3 | 3.3 |
| 157 | 39.6 | 3.7 | 31.2 | 3.2 | 35.4 | 5.9 |
| 158 | 25.2 | 11.5 | 26.4 | 11.8 | 25.8 | 0.8 |
| 159 | 24.6 | 7.4 | 22.5 | 6.1 | 23.6 | 1.5 |
| 160 | 101.4 | 17.4 | 86.1 | 16.5 | 93.7 | 10.8 |
| 161 | 90.3 | 12.2 | 65.3 | 16.3 | 77.8 | 17.7 |
| 162 | 74.4 | 11.1 | 66.2 | 12.6 | 70.3 | 5.8 |
| 163 | 19.5 | 2.8 | 10.2 | 2.2 | 14.8 | 6.6 |
| 164 | 23.3 | 2.6 | 18.1 | 3.6 | 20.7 | 3.6 |
| 165 | 16.7 | 7.7 | 10.4 | 4.2 | 13.6 | 4.5 |
| 166 | 27.2 | 4.2 | 23.2 | 2.7 | 25.2 | 2.8 |
| 167 | 87.0 | 10.1 | 77.9 | 8.7 | 82.5 | 6.4 |
| 168 | 116.7 | 39.9 | 89.4 | 27.8 | 103.1 | 19.3 |
| 169 | 100.9 | 7.7 | 87.6 | 5.3 | 94.2 | 9.4 |
| 170 | 95.2 | 22.4 | 83.3 | 18.1 | 89.3 | 8.4 |
| 171 | 47.4 | 10.3 | 42.2 | 9.8 | 44.8 | 3.7 |
| 172 | 63.3 | 14.3 | 43.2 | 10.7 | 53.2 | 14.2 |
| 173 | 55.6 | 10.5 | 48.9 | 8.3 | 52.2 | 4.7 |
| 174 | 45.5 | 6.5 | 38.9 | 7.5 | 42.2 | 4.6 |
| 175 | 45.5 | 15.1 | 33.2 | 13.4 | 39.4 | 8.7 |
| 176 | 30.7 | 7.3 | 30.2 | 6.2 | 30.4 | 0.3 |
| 177 | 46.4 | 7.4 | 45.0 | 5.9 | 45.7 | 1.0 |
| 178 | 38.9 | 4.9 | 41.3 | 5.2 | 40.1 | 1.7 |
| 179 | 63.6 | 12.7 | 49.6 | 14.6 | 56.6 | 9.9 |
| 180 | 80.4 | 9.9 | 72.2 | 8.1 | 76.3 | 5.8 |
| 181 | 68.2 | 7.5 | 50.7 | 7.1 | 59.4 | 12.4 |
| 182 | 37.9 | 22.9 | 53.0 | 24.5 | 45.5 | 10.7 |
| 183 | 93.8 | 20.0 | 89.0 | 17.9 | 91.4 | 3.4 |
| 184 | 95.3 | 21.4 | 132.1 | 24.0 | 113.7 | 26.0 |
| 185 | 77.4 | 5.5 | 79.3 | 9.4 | 78.3 | 1.4 |
| 186 | 55.1 | 3.5 | 39.1 | 4.1 | 47.1 | 11.4 |
| 187 | 69.3 | 37.6 | 78.8 | 30.9 | 74.0 | 6.7 |
| 188 | 81.2 | 15.0 | 66.2 | 14.1 | 73.7 | 10.6 |
| 189 | 57.2 | 15.8 | 58.6 | 12.4 | 57.9 | 1.0 |
| 190 | 69.4 | 29.6 | 70.6 | 28.9 | 70.0 | 0.9 |
| 191 | 77.3 | 8.0 | 62.2 | 7.6 | 69.7 | 10.7 |
| 192 | 79.9 | 42.5 | 67.8 | 28.7 | 73.9 | 8.5 |

NOTE:
*denotes triple-common.

These results show that DsiRNAs designed to target human SCAP mRNA can inhibit SCAP activity in cells (as determined by a reduced amount of SCAP mRNA in DsiRNA-transfected cells) and that the nucleotide sequences including the DsiRNA hits are useful for generating RNAi oligonucleotides to inhibit SCAP activity. Further, these results demonstrate that multiple SCAP target sequences are suitable for the RNAi-mediated inhibition of SCAP activity.

Example 3: RNAi Oligonucleotide Inhibition of SCAP Activity In Vitro—GalXC™-Based Compounds The DsiRNAs screened in Example 2 are selected for evaluation in vitro as GalXC™-based compounds. Briefly, the nucleotide sequences of the DsiRNAs are used to generate corresponding ds RNAi oligonucleotides including a nicked tetraloop GalNAc-conjugated structure (referred to herein as "GalXC™-SCAP oligonucleotides") having a 36-mer sense strand and a 22-mer antisense strand. Further, the nucleotide sequences for the sense strand and antisense strand of the GalXC™-SCAP oligonucleotides have a distinct pattern of modified nucleotides and phosphorothioate linkages (see, e.g., FIG. 1 for a schematic of the generic structure and chemical modification patterns of the GalXC™-SCAP oligonucleotides). The three adenosine nucleotides of the tetraloop each are conjugated to a GalNAc moiety (CAS #: 14131-60-3).

TABLE 3

GalXC™-SCAP Oligonucleotides (unmodified).

| GalXC-SCAP Oligo | Sense Strand (passenger; 36-mer) | SEQ ID NO: | Antisense Strand (guide; 22-mer) | SEQ ID NO: |
|---|---|---|---|---|
| 1 | UGUUUGCCUACAUCUACUUAGCAGCCGAAAGGCUGC | 9 | UAAGUAGAUGUAGGCAAACAGG | 10 |
| 2 | GUUUGCCUACAUCUACUUCAGCAGCCGAAAGGCUGC | 11 | UGAAGUAGAUGUAGGCAAACGG | 12 |
| 3 | UUUGCCUACAUCUACUUCUAGCAGCCGAAAGGCUGC | 13 | UAGAAGUAGAUGUAGGCAAAGG | 14 |
| 4 | GCCUACAUCUACUUCUCCAAGCAGCCGAAAGGCUGC | 15 | UUGGAGAAGUAGAUGUAGGCGG | 16 |
| 5 | AAGAUCGACAUGGUCAAGUAGCAGCCGAAAGGCUGC | 17 | UACUUGACCAUGUCGAUCUUGG | 18 |
| 6 | AGAUCGACAUGGUCAAGUCAGCAGCCGAAAGGCUGC | 19 | UGACUUGACCAUGUCGAUCUGG | 20 |
| 7 | AUCGACAUGGUCAAGUCCAAGCAGCCGAAAGGCUGC | 21 | UUGGACUUGACCAUGUCGAUGG | 22 |
| 8 | GUGUUGGUGCUCACCAAGUAGCAGCCGAAAGGCUGC | 23 | UACUUGGUGAGCACCAACACGG | 24 |
| 9 | UGUUGGUGCUCACCAAGUCAGCAGCCGAAAGGCUGC | 25 | UGACUUGGUGAGCACCAACAGG | 26 |
| 10 | GAGAGCUGGUCCAUCAUGAAGCAGCCGAAAGGCUGC | 27 | UUCAUGAUGGACCAGCUCUCGG | 28 |
| 11 | AGAGCUGGUCCAUCAUGAAAGCAGCCGAAAGGCUGC | 29 | UUUCAUGAUGGACCAGCUCUGG | 30 |
| 12 | GAGCUGGUCCAUCAUGAAGAGCAGCCGAAAGGCUGC | 31 | UCUUCAUGAUGGACCAGCUCGG | 32 |
| 13 | AGCUGGUCCAUCAUGAAGAAGCAGCCGAAAGGCUGC | 33 | UUCUUCAUGAUGGACCAGCUGG | 34 |
| 14 | GCUGGUCCAUCAUGAAGAAAGCAGCCGAAAGGCUGC | 35 | UUUCUUCAUGAUGGACCAGCGG | 36 |
| 15 | CUGGUCCAUCAUGAAGAACAGCAGCCGAAAGGCUGC | 37 | UGUUCUUCAUGAUGGACCAGGG | 38 |
| 16 | CCGUUGUCUGGAUUGGCAUAGCAGCCGAAAGGCUGC | 39 | UAUGCCAAUCCAGACAACGGGG | 40 |

TABLE 3-continued

| GalXC™-SCAP Oligonucleotides (unmodified). | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 17 | UUGUCUGGAUUGGC AUCCUAGCAGCCGA AAGGCUGC | 41 | UAGGAUGCCAAUCCAG ACAAGG | 42 |
| 18 | UGUCUGGAUUGGCA UCCUGAGCAGCCGA AAGGCUGC | 43 | UCAGGAUGCCAAUCCA GACAGG | 44 |
| 19 | GUCUGGAUUGGCAU CCUGGAGCAGCCGA AAGGCUGC | 45 | UCCAGGAUGCCAAUCC AGACGG | 46 |
| 20 | CUGGAUUGGCAUCC UGGUAAGCAGCCGA AAGGCUGC | 47 | UUACCAGGAUGCCAAU CCAGGG | 48 |
| 21 | UGGAUUGGCAUCCU GGUAUAGCAGCCGA AAGGCUGC | 49 | UAUACCAGGAUGCCAA UCCAGG | 50 |
| 22 | GGAUUGGCAUCCUG GUAUAAGCAGCCGA AAGGCUGC | 51 | UUAUACCAGGAUGCCA AUCCGG | 52 |
| 23 | GAUUGGCAUCCUGG UAUACAGCAGCCGA AAGGCUGC | 53 | UGUAUACCAGGAUGCC AAUCGG | 54 |
| 24 | AUUGGCAUCCUGGU AUACAAGCAGCCGA AAGGCUGC | 55 | UUGUAUACCAGGAUGC CAAUGG | 56 |
| 25 | CUCCAUCUUCCCAC CUGAUAGCAGCCGA AAGGCUGC | 57 | UAUCAGGUGGGAAGAU GGAGGG | 58 |
| 26 | CAUCUGCCUGUGGG AUGUAAGCAGCCGA AAGGCUGC | 59 | UUACAUCCCACAGGCA GAUGGG | 60 |
| 27 | UCUGCCUGUGGGAU GUACUAGCAGCCGA AAGGCUGC | 61 | UAGUACAUCCCACAGG CAGAGG | 62 |
| 28 | GUGGUGCAAGCUUG GGUGUAGCAGCCGA AAGGCUGC | 63 | UACACCCAAGCUUGCA CCACGG | 64 |
| 29 | UGGUGCAAGCUUGG GUGUCAGCAGCCGA AAGGCUGC | 65 | UGACACCCAAGCUUGC ACCAGG | 66 |
| 30 | GGUGCAAGCUUGGG UGUCAAGCAGCCGA AAGGCUGC | 67 | UUGACACCCAAGCUUG CACCGG | 68 |
| 31 | GUGCAAGCUUGGGU GUCAUAGCAGCCGA AAGGCUGC | 69 | UAUGACACCCAAGCUU GCACGG | 70 |
| 32 | GCAAGCUUGGGUGU CAUCUAGCAGCCGA AAGGCUGC | 71 | UAGAUGACACCCAAGC UUGCGG | 72 |
| 33 | CAAGCUUGGGUGUC AUCUCAGCAGCCGA AAGGCUGC | 73 | UGAGAUGACACCCAAG CUUGGG | 74 |
| 34 | AAGCUUGGGUGUCA UCUCAAGCAGCCGA AAGGCUGC | 75 | UUGAGAUGACACCCAA GCUUGG | 76 |

TABLE 3-continued

GalXC™-SCAP Oligonucleotides (unmodified).

| GalXC-SCAP Oligo | Sense Strand (passenger; 36-mer) | SEQ ID NO: | Antisense Strand (guide; 22-mer) | SEQ ID NO: |
|---|---|---|---|---|
| 35 | AGCUUGGGUGUCAUCUCAGAGCAGCCGAAAGGCUGC | 77 | UCUGAGAUGACACCCAAGCUGG | 78 |
| 36 | GCUUGGGUGUCAUCUCAGAAGCAGCCGAAAGGCUGC | 79 | UUCUGAGAUGACACCCAAGCGG | 80 |
| 37 | GUGUCUCCUUUUGGGACCUAGCAGCCGAAAGGCUGC | 81 | UAGGUCCCAAAAGGAGACACGG | 82 |
| 38 | UGUCUCCUUUUGGGACCUAAGCAGCCGAAAGGCUGC | 83 | UUAGGUCCCAAAAGGAGACAGG | 84 |
| 39 | GGGGACCUGUUACAGACAGAGCAGCCGAAAGGCUGC | 85 | UCUGUCUGUAACAGGUCCCCGG | 86 |
| 40 | GGGACCUGUUACAGACAGUAGCAGCCGAAAGGCUGC | 87 | UACUGUCUGUAACAGGUCCCGG | 88 |
| 41 | GGACCUGUUACAGACAGUCAGCAGCCGAAAGGCUGC | 89 | UGACUGUCUGUAACAGGUCCGG | 90 |
| 42 | GACCUGUUACAGACAGUCUAGCAGCCGAAAGGCUGC | 91 | UAGACUGUCUGUAACAGGUCGG | 92 |
| 43 | ACCUGUUACAGACAGUCUAAGCAGCCGAAAGGCUGC | 93 | UUAGACUGUCUGUAACAGGUGG | 94 |
| 44 | UGCCAUUGUCUGCAACUUUAGCAGCCGAAAGGCUGC | 95 | UAAAGUUGCAGACAAUGGCAGG | 96 |
| 45 | GCCAUUGUCUGCAACUUUGAGCAGCCGAAAGGCUGC | 97 | UCAAAGUUGCAGACAAUGGCGG | 98 |
| 46 | CCAUUGUCUGCAACUUUGGAGCAGCCGAAAGGCUGC | 99 | UCCAAAGUUGCAGACAAUGGGG | 100 |
| 47 | AUUGUCUGCAACUUUGGCAAGCAGCCGAAAGGCUGC | 101 | UUGCCAAAGUUGCAGACAAUGG | 102 |
| 48 | UCUGCAACUUUGGCAGUGAAGCAGCCGAAAGGCUGC | 103 | UUCACUGCCAAAGUUGCAGAGG | 104 |
| 49 | CUACCCACUGCUGAAACUCAGCAGCCGAAAGGCUGC | 105 | UGAGUUUCAGCAGUGGGUAGGG | 106 |
| 50 | GCCAGGAACAGGACCUGUGAGCAGCCGAAAGGCUGC | 107 | UCACAGGUCCUGUUCCUGGCGG | 108 |
| 51 | GAACAGGACCUGUGGAAUUAGCAGCCGAAAGGCUGC | 109 | UAAUUCCACAGGUCCUGUUCGG | 110 |
| 52 | ACAGGACCUGUGGAAUUCAAGCAGCCGAAAGGCUGC | 111 | UUGAAUUCCACAGGUCCUGUGG | 112 |

TABLE 3-continued

GalXC™-SCAP Oligonucleotides (unmodified).

| GalXC-SCAP Oligo | Sense Strand (passenger; 36-mer) | SEQ ID NO: | Antisense Strand (guide; 22-mer) | SEQ ID NO: |
|---|---|---|---|---|
| 53 | UGGAAUUCACCACC CCUGUAGCAGCCGA AAGGCUGC | 113 | UACAGGGGUGGUGAAU UCCAGG | 114 |
| 54 | CUUGUGACCACCUA CAUCAAGCAGCCGA AAGGCUGC | 115 | UUGAUGUAGGUGGUCA CAAGGG | 116 |
| 55 | UUGUGACCACCUAC AUCAUAGCAGCCGA AAGGCUGC | 117 | UAUGAUGUAGGUGGUC ACAAGG | 118 |
| 56 | UGUGACCACCUACA UCAUCAGCAGCCGA AAGGCUGC | 119 | UGAUGAUGUAGGUGGU CACAGG | 120 |
| 57 | GUGACCACCUACAU CAUCUAGCAGCCGA AAGGCUGC | 121 | UAGAUGAUGUAGGUGG UCACGG | 122 |
| 58 | UGACCACCUACAUC AUCUUAGCAGCCGA AAGGCUGC | 123 | UAAGAUGAUGUAGGUG GUCAGG | 124 |
| 59 | GACCACCUACAUCA UCUUGAGCAGCCGA AAGGCUGC | 125 | UCAAGAUGAUGUAGGU GGUCGG | 126 |
| 60 | ACCACCUACAUCAU CUUGUAGCAGCCGA AAGGCUGC | 127 | UACAAGAUGAUGUAGG UGGUGG | 128 |
| 61 | CCACCUACAUCAUC UUGUUAGCAGCCGA AAGGCUGC | 129 | UAACAAGAUGAUGUAG GUGGGG | 130 |
| 62 | CACCUACAUCAUCU UGUUUAGCAGCCGA AAGGCUGC | 131 | UAAACAAGAUGAUGUA GGUGGG | 132 |
| 63 | ACCUACAUCAUCUU GUUUGAGCAGCCGA AAGGCUGC | 133 | UCAAACAAGAUGAUGU AGGUGG | 134 |
| 64 | CCUACAUCAUCUUG UUUGCAGCAGCCGA AAGGCUGC | 135 | UGCAAACAAGAUGAUG UAGGGG | 136 |
| 65 | CUACAUCAUCUUGU UUGCCAGCAGCCGA AAGGCUGC | 137 | UGGCAAACAAGAUGAU GUAGGG | 138 |
| 66 | ACAUCAUCUUGUUU GCCUAAGCAGCCGA AAGGCUGC | 139 | UUAGGCAAACAAGAUG AUGUGG | 140 |
| 67 | AUCAUCUUGUUUGC CUACAAGCAGCCGA AAGGCUGC | 141 | UUGUAGGCAAACAAGA UGAUGG | 142 |
| 68 | UCAUCUUGUUUGCC UACAUAGCAGCCGA AAGGCUGC | 143 | UAUGUAGGCAAACAAG AUGAGG | 144 |
| 69 | AUCUUGUUUGCCUA CAUCUAGCAGCCGA AAGGCUGC | 145 | UAGAUGUAGGCAAACA AGAUGG | 146 |
| 70 | UCUUGUUUGCCUAC AUCUAAGCAGCCGA AAGGCUGC | 147 | UUAGAUGUAGGCAAAC AAGAGG | 148 |

TABLE 3-continued

| GalXC™-SCAP Oligonucleotides (unmodified). | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 71 | UUUCCCCUACCUUGUGGUGAGCAGCCGAAAGGCUGC | 149 | UCACCACAAGGUAGGGGAAAGG | 150 |
| 72 | UUCCCCUACCUUGUGGUGGAGCAGCCGAAAGGCUGC | 151 | UCCACCACAAGGUAGGGGAAGG | 152 |
| 73 | CCCUACCUUGUGGUGGUUAAGCAGCCGAAAGGCUGC | 153 | UUAACCACCACAAGGUAGGGGG | 154 |
| 74 | CUACCUUGUGGUGGUUAUUAGCAGCCGAAAGGCUGC | 155 | UAAUAACCACCACAAGGUAGGG | 156 |
| 75 | UACCUUGUGGUGGUUAUUGAGCAGCCGAAAGGCUGC | 157 | UCAAUAACCACCACAAGGUAGG | 158 |
| 76 | ACCUUGUGGUGGUUAUUGGAGCAGCCGAAAGGCUGC | 159 | UCCAAUAACCACCACAAGGUGG | 160 |
| 77 | CCUUGUGGUGGUUAUUGGGAGCAGCCGAAAGGCUGC | 161 | UCCCAAUAACCACCACAAGGGG | 162 |
| 78 | CUUGUGGUGGUUAUUGGGUAGCAGCCGAAAGGCUGC | 163 | UACCCAAUAACCACCACAAGGG | 164 |
| 79 | UUGUGGUGGUUAUUGGGUUAGCAGCCGAAAGGCUGC | 165 | UAACCCAAUAACCACCACAAGG | 166 |
| 80 | UGUGGUGGUUAUUGGGUUAAGCAGCCGAAAGGCUGC | 167 | UUAACCCAAUAACCACCACAGG | 168 |
| 81 | GUGGUGGUUAUUGGGUUAGAGCAGCCGAAAGGCUGC | 169 | UCUAACCCAAUAACCACCACGG | 170 |
| 82 | UGGUGGUUAUUGGGUUAGAAGCAGCCGAAAGGCUGC | 171 | UUCUAACCCAAUAACCACCAGG | 172 |
| 83 | GGUGGUUAUUGGGUUAGAGAGCAGCCGAAAGGCUGC | 173 | UCUCUAACCCAAUAACCACCGG | 174 |
| 84 | GUGGUUAUUGGGUUAGAGAAGCAGCCGAAAGGCUGC | 175 | UUCUCUAACCCAAUAACCACGG | 176 |
| 85 | UGGUUAUUGGGUUAGAGAAAGCAGCCGAAAGGCUGC | 177 | UUUCUCUAACCCAAUAACCAGG | 178 |
| 86 | GGUUAUUGGGUUAGAGAAUAGCAGCCGAAAGGCUGC | 179 | UAUUCUCUAACCCAAUAACCGG | 180 |
| 87 | GUUAUUGGGUUAGAGAAUGAGCAGCCGAAAGGCUGC | 181 | UCAUUCUCUAACCCAAUAACGG | 182 |
| 88 | UUAUUGGGUUAGAGAAUGUAGCAGCCGAAAGGCUGC | 183 | UACAUUCUCUAACCCAAUAAGG | 184 |

TABLE 3-continued

GalXC™-SCAP Oligonucleotides (unmodified).

| GalXC-SCAP Oligo | Sense Strand (passenger; 36-mer) | SEQ ID NO: | Antisense Strand (guide; 22-mer) | SEQ ID NO: |
|---|---|---|---|---|
| 89 | AUUGGGUUAGAGA AUGUGUAGCAGCCG AAAGGCUGC | 185 | UACACAUUCUCUAACC CAAUGG | 186 |
| 90 | UUGGGUUAGAGAA UGUGUUAGCAGCCG AAAGGCUGC | 187 | UAACACAUUCUCUAAC CCAAGG | 188 |
| 91 | GGUUAGAGAAUGU GUUGGUAGCAGCCG AAAGGCUGC | 189 | UACCAACACAUUCUCU AACCGG | 190 |
| 92 | GUUAGAGAAUGUG UUGGUGAGCAGCCG AAAGGCUGC | 191 | UCACCAACACAUUCUC UAACGG | 192 |
| 93 | UUAGAGAAUGUGU UGGUGCAGCAGCCG AAAGGCUGC | 193 | UGCACCAACACAUUCU CUAAGG | 194 |
| 94 | UAGAGAAUGUGUU GGUGCUAGCAGCCG AAAGGCUGC | 195 | UAGCACCAACACAUUC UCUAGG | 196 |
| 95 | AGAGAAUGUGUUG GUGCUCAGCAGCCG AAAGGCUGC | 197 | UGAGCACCAACACAUU CUCUGG | 198 |
| 96 | GAGAAUGUGUUGG UGCUCAAGCAGCCG AAAGGCUGC | 199 | UUGAGCACCAACACAU UCUCGG | 200 |
| 97 | AGAAUGUGUUGGU GCUCACAGCAGCCG AAAGGCUGC | 201 | UGUGAGCACCAACACA UUCUGG | 202 |
| 98 | AAUGUGUUGGUGC UCACCAAGCAGCCG AAAGGCUGC | 203 | UUGGUGAGCACCAACA CAUUGG | 204 |
| 99 | AUGUGUUGGUGCUC ACCAAAGCAGCCGA AAGGCUGC | 205 | UUUGGUGAGCACCAAC ACAUGG | 206 |
| 100 | UGUGUUGGUGCUCA CCAAGAGCAGCCGA AAGGCUGC | 207 | UCUUGGUGAGCACCAA CACAGG | 208 |
| 101 | UGGUCCAUCAUGAA GAACAAGCAGCCGA AAGGCUGC | 209 | UUGUUCUUCAUGAUGG ACCAGG | 210 |
| 102 | GGUCCAUCAUGAAG AACAUAGCAGCCGA AAGGCUGC | 211 | UAUGUUCUUCAUGAUG GACCGG | 212 |
| 103 | CUGACUUCUUCCUU CAGAUAGCAGCCGA AAGGCUGC | 213 | UAUCUGAAGGAAGAAG UCAGGG | 214 |
| 104 | ACUUCUUCCUUCAG AUGCUAGCAGCCGA AAGGCUGC | 215 | UAGCAUCUGAAGGAAG AAGUGG | 216 |
| 105 | UCCUUCAGAUGCUG UUUUUAGCAGCCGA AAGGCUGC | 217 | UAAAAACAGCAUCUGA AGGAGG | 218 |
| 106 | CCUUCAGAUGCUGU UUUUCAGCAGCCGA AAGGCUGC | 219 | UGAAAAACAGCAUCUG AAGGGG | 220 |

TABLE 3-continued

GalXC™-SCAP Oligonucleotides (unmodified).

| GalXC-SCAP Oligo | Sense Strand (passenger; 36-mer) | SEQ ID NO: | Antisense Strand (guide; 22-mer) | SEQ ID NO: |
|---|---|---|---|---|
| 107 | CUUCAGAUGCUGUUUUUCAAGCAGCCGAAAGGCUGC | 221 | UUGAAAAACAGCAUCUGAAGGG | 222 |
| 108 | UUCAGAUGCUGUUUUUCACAGCAGCCGAAAGGCUGC | 223 | UGUGAAAAACAGCAUCUGAAGG | 224 |
| 109 | CAGAUGCUGUUUUUCACCAAGCAGCCGAAAGGCUGC | 225 | UUGGUGAAAAACAGCAUCUGGG | 226 |
| 110 | AGAUGCUGUUUUUCACCACAGCAGCCGAAAGGCUGC | 227 | UGUGGUGAAAAACAGCAUCUGG | 228 |
| 111 | GAUGCUGUUUUUCACCACUAGCAGCCGAAAGGCUGC | 229 | UAGUGGUGAAAAACAGCAUCGG | 230 |
| 112 | AUGCUGUUUUUCACCACUGAGCAGCCGAAAGGCUGC | 231 | UCAGUGGUGAAAAACAGCAUGG | 232 |
| 113 | UGCUGUUUUUCACCACUGUAGCAGCCGAAAGGCUGC | 233 | UACAGUGGUGAAAAACAGCAGG | 234 |
| 114 | GCUGUUUUUCACCACUGUCAGCAGCCGAAAGGCUGC | 235 | UGACAGUGGUGAAAAACAGCGG | 236 |
| 115 | UGUUUUUCACCACUGUCCUAGCAGCCGAAAGGCUGC | 237 | UAGGACAGUGGUGAAAAACAGG | 238 |
| 116 | GUUUUUCACCACUGUCCUGAGCAGCCGAAAGGCUGC | 239 | UCAGGACAGUGGUGAAAAACGG | 240 |
| 117 | UUUUUCACCACUGUCCUGUAGCAGCCGAAAGGCUGC | 241 | UACAGGACAGUGGUGAAAAAGG | 242 |
| 118 | UUUUCACCACUGUCCUGUCAGCAGCCGAAAGGCUGC | 243 | UGACAGGACAGUGGUGAAAAGG | 244 |
| 119 | UUCACCACUGUCCUGUCCAAGCAGCCGAAAGGCUGC | 245 | UUGGACAGGACAGUGGUGAAGG | 246 |
| 120 | CACCACUGUCCUGUCCAUUAGCAGCCGAAAGGCUGC | 247 | UAAUGGACAGGACAGUGGUGGG | 248 |
| 121 | ACCACUGUCCUGUCCAUUGAGCAGCCGAAAGGCUGC | 249 | UCAAUGGACAGGACAGUGGUGG | 250 |
| 122 | CCACUGUCCUGUCCAUUGAAGCAGCCGAAAGGCUGC | 251 | UUCAAUGGACAGGACAGUGGGG | 252 |
| 123 | CACUGUCCUGUCCAUUGACAGCAGCCGAAAGGCUGC | 253 | UGUCAAUGGACAGGACAGUGGG | 254 |
| 124 | ACUGUCCUGUCCAUUGACAAGCAGCCGAAAGGCUGC | 255 | UUGUCAAUGGACAGGACAGUGG | 256 |

TABLE 3-continued

GalXC™-SCAP Oligonucleotides (unmodified).

| GalXC-SCAP Oligo | Sense Strand (passenger; 36-mer) | SEQ ID NO: | Antisense Strand (guide; 22-mer) | SEQ ID NO: |
|---|---|---|---|---|
| 125 | CUAAGCUACCUGAG AACCAAGCAGCCGA AAGGCUGC | 257 | UUGGUUCUCAGGUAGC UUAGGG | 258 |
| 126 | GAGGUCCAGCAGAG GUUGUAGCAGCCGA AAGGCUGC | 259 | UACAACCUCUGCUGGA CCUCGG | 260 |
| 127 | GCAGAGGUUGUCCA UGACAAGCAGCCGA AAGGCUGC | 261 | UUGUCAUGGACAACCU CUGCGG | 262 |
| 128 | CAGAGGUUGUCCAU GACAGAGCAGCCGA AAGGCUGC | 263 | UCUGUCAUGGACAACC UCUGGG | 264 |
| 129 | GAGGAUGAGGAAC UUUGGAAGCAGCCG AAAGGCUGC | 265 | UUCCAAAGUUCCUCAU CCUCGG | 266 |
| 130 | GAACUUUGGAGGA AAUUGUAGCAGCCG AAAGGCUGC | 267 | UACAAUUUCCUCCAAA GUUCGG | 268 |
| 131 | GACGCUCUUCAGCU AUUACAGCAGCCGA AAGGCUGC | 269 | UGUAAUAGCUGAAGAG CGUCGG | 270 |
| 132 | ACGCUCUUCAGCUA UUACAAGCAGCCGA AAGGCUGC | 271 | UUGUAAUAGCUGAAGA GCGUGG | 272 |
| 133 | CGCUCUUCAGCUAU UACAAAGCAGCCGA AAGGCUGC | 273 | UUUGUAAUAGCUGAAG AGCGGG | 274 |
| 134 | GCUCUUCAGCUAUU ACAACAGCAGCCGA AAGGCUGC | 275 | UGUUGUAAUAGCUGAA GAGCGG | 276 |
| 135 | CUCUUCAGCUAUUA CAACAAGCAGCCGA AAGGCUGC | 277 | UUGUUGUAAUAGCUGA AGAGGG | 278 |
| 136 | UCUUCAGCUAUUAC AACAUAGCAGCCGA AAGGCUGC | 279 | UAUGUUGUAAUAGCUG AAGAGG | 280 |
| 137 | CUUCAGCUAUUACA ACAUCAGCAGCCGA AAGGCUGC | 281 | UGAUGUUGUAAUAGCU GAAGGG | 282 |
| 138 | UUCAGCUAUUACAA CAUCAAGCAGCCGA AAGGCUGC | 283 | UUGAUGUUGUAAUAGC UGAAGG | 284 |
| 139 | CCAGCCUGACCUCA CCUGCAGCAGCCGA AAGGCUGC | 285 | UGCAGGUGAGGUCAGG CUGGGG | 286 |
| 140 | CAGCCUGACCUCAC CUGCUAGCAGCCGA AAGGCUGC | 287 | UAGCAGGUGAGGUCAG GCUGGG | 288 |
| 141 | AGCCUGACCUCACC UGCUUAGCAGCCGA AAGGCUGC | 289 | UAAGCAGGUGAGGUCA GGCUGG | 290 |
| 142 | GCCUGACCUCACCU GCUUAAGCAGCCGA AAGGCUGC | 291 | UUAAGCAGGUGAGGUC AGGCGG | 292 |

TABLE 3-continued

| GalXC™-SCAP Oligonucleotides (unmodified). | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 143 | CCUGACCUCACCUG CUUAAAGCAGCCGA AAGGCUGC | 293 | UUUAAGCAGGUGAGGU CAGGGG | 294 |
| 144 | CUGACCUCACCUGC UUAAUAGCAGCCGA AAGGCUGC | 295 | UAUUAAGCAGGUGAGG UCAGGG | 296 |
| 145 | UGACCUCACCUGCU UAAUUAGCAGCCGA AAGGCUGC | 297 | UAAUUAAGCAGGUGAG GUCAGG | 298 |
| 146 | GACCUCACCUGCUU AAUUGAGCAGCCGA AAGGCUGC | 299 | UCAAUUAAGCAGGUGA GGUCGG | 300 |
| 147 | ACCUCACCUGCUUA AUUGAAGCAGCCGA AAGGCUGC | 301 | UUCAAUUAAGCAGGUG AGGUGG | 302 |
| 148 | CCUCACCUGCUUAA UUGACAGCAGCCGA AAGGCUGC | 303 | UGUCAAUUAAGCAGGU GAGGGG | 304 |
| 149 | CUCACCUGCUUAAU UGACAAGCAGCCGA AAGGCUGC | 305 | UUGUCAAUUAAGCAGG UGAGGG | 306 |
| 150 | UCACCUGCUUAAUU GACACAGCAGCCGA AAGGCUGC | 307 | UGUGUCAAUUAAGCAG GUGAGG | 308 |
| 151 | CACCUGCUUAAUUG ACACCAGCAGCCGA AAGGCUGC | 309 | UGGUGUCAAUUAAGCA GGUGGG | 310 |
| 152 | ACCUGCUUAAUUGA CACCAAGCAGCCGA AAGGCUGC | 311 | UUGGUGUCAAUUAAGC AGGUGG | 312 |
| 153 | CCUGCUUAAUUGAC ACCAAAGCAGCCGA AAGGCUGC | 313 | UUUGGUGUCAAUUAAG CAGGGG | 314 |
| 154 | CUGCUUAAUUGACA CCAACAGCAGCCGA AAGGCUGC | 315 | UGUUGGUGUCAAUUAA GCAGGG | 316 |
| 155 | UGCUUAAUUGACAC CAACUAGCAGCCGA AAGGCUGC | 317 | UAGUUGGUGUCAAUUA AGCAGG | 318 |
| 156 | GCUUAAUUGACACC AACUUAGCAGCCGA AAGGCUGC | 319 | UAAGUUGGUGUCAAUU AAGCGG | 320 |
| 157 | CUUAAUUGACACCA ACUUUAGCAGCCGA AAGGCUGC | 321 | UAAAGUUGGUGUCAAU UAAGGG | 322 |
| 158 | UUAAUUGACACCAA CUUUUAGCAGCCGA AAGGCUGC | 323 | UAAAAGUUGGUGUCAA UUAAGG | 324 |
| 159 | UAAUUGACACCAAC UUUUCAGCAGCCGA AAGGCUGC | 325 | UGAAAAGUUGGUGUCA AUUAGG | 326 |
| 160 | AUUGAAGGGGUGC UGUGCUAGCAGCCG AAAGGCUGC | 327 | UAGCACAGCACCCCUUC AAUGG | 328 |

TABLE 3-continued

GalXC™-SCAP Oligonucleotides (unmodified).

| GalXC-SCAP Oligo | Sense Strand (passenger; 36-mer) | SEQ ID NO: | Antisense Strand (guide; 22-mer) | SEQ ID NO: |
|---|---|---|---|---|
| 161 | CUUGGACAAAAGGA UUGUGAGCAGCCGA AAGGCUGC | 329 | UCACAAUCCUUUUGUC CAAGGG | 330 |
| 162 | UUGGACAAAAGGA UUGUGGAGCAGCCG AAAGGCUGC | 331 | UCCACAAUCCUUUUGU CCAAGG | 332 |
| 163 | UCAACGGUUCCCUU GAUUUAGCAGCCGA AAGGCUGC | 333 | UAAAUCAAGGGAACCG UUGAGG | 334 |
| 164 | CAACGGUUCCCUUG AUUUCAGCAGCCGA AAGGCUGC | 335 | UGAAAUCAAGGGAACC GUUGGG | 336 |
| 165 | AACGGUUCCCUUGA UUUCUAGCAGCCGA AAGGCUGC | 337 | UAGAAAUCAAGGGAAC CGUUGG | 338 |
| 166 | ACGGUUCCCUUGAU UUCUUAGCAGCCGA AAGGCUGC | 339 | UAAGAAAUCAAGGGAA CCGUGG | 340 |
| 167 | GUACAUUGACCAGA CCAUGAGCAGCCGA AAGGCUGC | 341 | UCAUGGUCUGGUCAAU GUACGG | 342 |
| 168 | ACCUGUACCACCUC CUGUGAGCAGCCGA AAGGCUGC | 343 | UCACAGGAGGUGGUAC AGGUGG | 344 |
| 169 | CCUGUACCACCUCC UGUGUAGCAGCCGA AAGGCUGC | 345 | UACACAGGAGGUGGUA CAGGGG | 346 |
| 170 | GUACCACCUCCUGU GUCAUAGCAGCCGA AAGGCUGC | 347 | UAUGACACAGGAGGUG GUACGG | 348 |
| 171 | GCACAGGCAUCAAG UUCUAAGCAGCCGA AAGGCUGC | 349 | UUAGAACUUGAUGCCU GUGCGG | 350 |
| 172 | ACAGGCAUCAAGUU CUACUAGCAGCCGA AAGGCUGC | 351 | UAGUAGAACUUGAUGC CUGUGG | 352 |
| 173 | CAGGCAUCAAGUUC UACUCAGCAGCCGA AAGGCUGC | 353 | UGAGUAGAACUUGAUG CCUGGG | 354 |
| 174 | AGGCAUCAAGUUCU ACUCCAGCAGCCGA AAGGCUGC | 355 | UGGAGUAGAACUUGAU GCCUGG | 356 |
| 175 | GGCAUCAAGUUCUA CUCCAAGCAGCCGA AAGGCUGC | 357 | UUGGAGUAGAACUUGA UGCCGG | 358 |
| 176 | GCAUCAAGUUCUAC UCCAUAGCAGCCGA AAGGCUGC | 359 | UAUGGAGUAGAACUUG AUGCGG | 360 |
| 177 | CAUCAAGUUCUACU CCAUUAGCAGCCGA AAGGCUGC | 361 | UAAUGGAGUAGAACUU GAUGGG | 362 |
| 178 | AUCAAGUUCUACUC CAUUCAGCAGCCGA AAGGCUGC | 363 | UGAAUGGAGUAGAACU UGAUGG | 364 |

TABLE 3-continued

| GalXC™-SCAP Oligonucleotides (unmodified). | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 179 | UCAAGUUCUACUCC AUUCAAGCAGCCGA AAGGCUGC | 365 | UUGAAUGGAGUAGAAC UUGAGG | 366 |
| 180 | CAAGUUCUACUCCA UUCAGAGCAGCCGA AAGGCUGC | 367 | UCUGAAUGGAGUAGAA CUUGGG | 368 |
| 181 | AAGUUCUACUCCAU UCAGCAGCAGCCGA AAGGCUGC | 369 | UGCUGAAUGGAGUAGA ACUUGG | 370 |
| 182 | AGUUCUACUCCAUU CAGCAAGCAGCCGA AAGGCUGC | 371 | UUGCUGAAUGGAGUAG AACUGG | 372 |
| 183 | GUUCUACUCCAUUC AGCAGAGCAGCCGA AAGGCUGC | 373 | UCUGCUGAAUGGAGUA GAACGG | 374 |
| 184 | GUGUCAUCUCAGAC AACCUAGCAGCCGA AAGGCUGC | 375 | UAGGUUGUCUGAGAUG ACACGG | 376 |
| 185 | CAUCUCAGACAACC UGCUGAGCAGCCGA AAGGCUGC | 377 | UCAGCAGGUUGUCUGA GAUGGG | 378 |
| 186 | UCAGACAACCUGCU GGUGAAGCAGCCGA AAGGCUGC | 379 | UUCACCAGCAGGUUGU CUGAGG | 380 |
| 187 | CGGGGACCUGUUAC AGACAAGCAGCCGA AAGGCUGC | 381 | UUGUCUGUAACAGGUC CCCGGG | 382 |
| 188 | GACAACGCUGCCAU UGUCUAGCAGCCGA AAGGCUGC | 383 | UAGACAAUGGCAGCGU UGUCGG | 384 |
| 189 | GCUGCCUCCUGACU GUAAUAGCAGCCGA AAGGCUGC | 385 | UAUUACAGUCAGGAGG CAGCGG | 386 |
| 190 | CUGCCUCCUGACUG UAAUAAGCAGCCGA AAGGCUGC | 387 | UUAUUACAGUCAGGAG GCAGGG | 388 |
| 191 | UAAUAUUAAACUU UUUUAAAGCAGCCG AAAGGCUGC | 389 | UUUAAAAAAGUUUAAU AUUAGG | 390 |
| 192 | AAUAUUAAACUUU UUUAAAAGCAGCCG AAAGGCUGC | 391 | UUUUAAAAAAGUUUAA UAUUGG | 392 |

TABLE 4

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| 1 | [mUs][mG][mU][mU][mU][mG][mC][fC][fU][fA]]fC][mA][mU][mC][mU][mA][mC][mU][mU][mA][mG][mC][mA][mG][mC][mC][mG][ademA-GalNAc][ademA-GalNAc][ademA-GalNAc][mG][mG][mC][mU][mG][mC] | 393 | [MePhosphonate-4O-mUs][fAs][fAs][fG][fU][mA][fG][mA][mU][fG][mU][mA][mG][fG][mC][mA][mA][mA][mC][mAs][mGs][mG] | 394 |
| 2 | [mGs][mU][mU][mU][mG][mC][mC][fU][fA][fC][fA][mU][mC][mU][mA][mC][mU][mU][mC][mA][mG][mC][mA][mG][mC][mC][mG][ademA-GalNAc][ademA-GalNAc][ademA-GalNAc][mG][mG][mC][mU][mG][mC] | 395 | [MePhosphonate-4O-mUs][fGs][fAs][fA][fG][mU][fA][mG][mA][fU][mG][mU][mA][fG][mG][mC][mA][mA][mA][mCs][mGs][mG] | 396 |
| 3 | [mUs][mU][mU][mG][mC][mC][mU][fA][fC][fA][fU][mC][mU][mA][mC][mU][mU][mC][mU][mA][mG][mC][mA][mG][mC][mC][mG][ademA-GalNAc][ademA-GalNAc][ademA-GalNAc][mG][mG][mC][mU][mG][mC] | 397 | [MePhosphonate-4O-mUs][fAs][fGs][fA][fA][mG][fU][mA][mG][fA][mU][mG][mU][fA][mG][mG][mC][mA][mA][mAs][mGs][mG] | 398 |
| 4 | [mGs][mC][mC][mU][mA][mC][mA][fU][fC][fU][fA][mC][mU][mU][mC][mU][mC][mC][mA][mA][mG][mC][mA][mG][mC][mC][mG][ademA-GalNAc][ademA-GalNAc][ademA-GalNAc][mG][mG][mC][mU][mG][mC] | 399 | [MePhosphonate-4O-mUs][fUs][fGs][fG][fA][mG][fA][mA][mG][fU][mA][mG][mA][fU][mG][mU][mA][mG][mG][mCs][mGs][mG] | 400 |
| 5 | [mAs][mA][mG][mA][mU][mC][mG][fA][fC][fA][fU][mG][mG][mU][mC][mA][mA][mG][mU][mA][mG][mC][mA][mG][mC][mC][mG][ademA-GalNAc][ademA-GalNAc][ademA-GalNAc][mG][mG][mC][mU][mG][mC] | 401 | [MePhosphonate-4O-mUs][fAs][fCs][fU][fU][mG][fA][mC][mC][fA][mU][mG][mU][fC][mG][mA][mU][mC][mU][mUs][mGs][mG] | 402 |
| 6 | [mAs][mG][mA][mU][mC][mG][mA][fC][fA][fU][fG][mG][mU][mC][mA][mA][mG][mU][mC][mA][mG][mC][mA][mG][mC][mC][mG][ademA-GalNAc][ademA-GalNAc][ademA-GalNAc][mG][mG][mC][mU][mG][mC] | 403 | [MePhosphonate-4O-mUs][fGs][fAs][fC][fU][mU][fG][mA][mC][fC][mA][mU][mG][fU][mC][mG][mA][mU][mC][mUs][mGs][mG] | 404 |
| 7 | [mAs][mU][mC][mG][mA][mC][mA][fU][fG][fG][fU][mC][mA][mA][mG][mU][mC][mC][mA][mA][mG][mC][mA][mG][mC][mC][mG][ademA-GalNAc][ademA-GalNAc][ademA-GalNAc][mG][mG][mC][mU][mG][mC] | 405 | [MePhosphonate-4O-mUs][fUs][fGs][fG][fA][mC][fU][mU][mG][fA][mC][mC][mA][fU][mG][mU][mC][mG][mA][mUs][mGs][mG] | 406 |
| 8 | [mGs][mU][mG][mU][mU][mG][mG][fU][fG][fC][fU][mC][mA][mC][mC][mA][mA][mG][mU][mA][mG][mC][mA][mG][mC][mC][mG][ademA-GalNAc][ademA-GalNAc][ademA-GalNAc][mG][mG][mC][mU][mG][mC] | 407 | [MePhosphonate-4O-mUs][fAs][fCs][fU][fU][mG][fG][mU][mG][fA][mG][mC][mA][fC][mC][mA][mA][mC][mA][mCs][mGs][mG] | 408 |
| 9 | [mUs][mG][mU][mU][mG][mG][mU][fG][fC][fU][fC][mA][mC][mC][mA][mA][mG][mU][mC][mA][mG][mC][mA][mG][mC][mC][mG][ademA-GalNAc][ademA-GalNAc][ademA-GalNAc][mG][mG][mC][mU][mG][mC] | 409 | [MePhosphonate-4O-mUs][fGs][fAs][fC][fU][mU][fG][mG][mU][fG][mA][mG][mC][fA][mC][mC][mA][mA][mC][mAs][mGs][mG] | 410 |
| 10 | [mGs][mA][mG][mA][mG][mC][mU][fG][fG] | 411 | [MePhosphonate-4O-mUs][fUs][fCs][fA][fU][mG] | 412 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [fU][fC][mC][mA][mU]<br>[mC][mA][mU][mG][mA]<br>[mA][mG][mC][mA][mG]<br>[mC][mC][mG][ademA-GalNAc]<br>[ademA-GalNAc][ademA-GalNAc][mG]<br>[mG][mC][mU][mG][mC] | | [fA][mU][mG][fG][mA][mC]<br>[mC][fA][mG][mC][mU][mC]<br>[mU][mCs][mGs][mG] | |
| 11 | [mAs][mG][mA][mG]<br>[mC][mU][mG][fG][fU]<br>[fC][fC][mA][mU][mC]<br>[mA][mU][mG][mA][mA]<br>[mA][mG][mC][mA][mG]<br>[mC][mC][mG][ademA-GalNAc]<br>[ademA-GalNAc][ademA-GalNAc][mG]<br>[mG][mC][mU][mG][mC] | 413 | [MePhosphonate-4O-<br>mUs][fUs][fUs][fC][fA][mU]<br>[fG][mA][mU][fG][mG][mA]<br>[mC][fC][mA][mG][mC][mU]<br>[mC][mUs][mGs][mG] | 414 |
| 12 | [mGs][mA][mG][mC]<br>[mU][mG][mG][fU][fC]<br>[fC][fA][mU][mC][mA]<br>[mU][mG][mA][mA][mG]<br>[mA][mG][mC][mA][mG]<br>[mC][mC][mG][ademA-GalNAc]<br>[ademA-GalNAc][ademA-GalNAc][mG]<br>[mG][mC][mU][mG][mC] | 415 | [MePhosphonate-4O-<br>mUs][fCs][fUs][fU][fC][mA]<br>[fU][mG][mA][fU][mG][mG]<br>[mA][fC][mC][mA][mG][mC]<br>[mU][mCs][mGs][mG] | 416 |
| 13 | [mAs][mG][mC][mU]<br>[mG][mG][mU][fC][fC]<br>[fA][fU][mC][mA][mU]<br>[mG][mA][mA][mG][mA]<br>[mA][mG][mC][mA][mG]<br>[mC][mC][mG][ademA-GalNAc]<br>[ademA-GalNAc][ademA-GalNAc][mG]<br>[mG][mC][mU][mG][mC] | 417 | [MePhosphonate-4O-<br>mUs][fUs][fCs][fU][fU][mC]<br>[fA][mU][mG][fA][mU][mG]<br>[mG][fA][mC][mC][mA][mG]<br>[mC][mUs][mGs][mG] | 418 |
| 14 | [mGs][mC][mU][mG]<br>[mG][mU][mC][fC][fA]<br>[fU][fC][mA][mU][mG]<br>[mA][mA][mG][mA][mA]<br>[mA][mG][mC][mA][mG]<br>[mC][mC][mG][ademA-GalNAc]<br>[ademA-GalNAc][ademA-GalNAc][mG]<br>[mG][mC][mU][mG][mC] | 419 | [MePhosphonate-4O-<br>mUs][fUs][fUs][fC][fU][mU]<br>[fC][mA][mU][fG][mA][mU]<br>[mG][fG][mA][mC][mC][mA]<br>[mG][mCs][mGs][mG] | 420 |
| 15 | [mCs][mU][mG][mG]<br>[mU][mC][mC][fA][fU]<br>[fC][fA][mU][mG][mA]<br>[mA][mG][mA][mA][mC]<br>[mA][mG][mC][mA][mG]<br>[mC][mC][mG][ademA-GalNAc]<br>[ademA-GalNAc][ademA-GalNAc][mG]<br>[mG][mC][mU][mG][mC] | 421 | [MePhosphonate-4O-<br>mUs][fGs][fUs][fU][fC][mU]<br>[fU][mC][mA][fU][mG][mA]<br>[mU][fG][mG][mA][mC][mC]<br>[mA][mGs][mGs][mG] | 422 |
| 16 | [mCs][mC][mG][mU]<br>[mU][mG][mU][fC][fU]<br>[fG][fG][mA][mU][mU]<br>[mG][mG][mC][mA][mU]<br>[mA][mG][mC][mA][mG]<br>[mC][mC][mG][ademA-GalNAc]<br>[ademA-GalNAc][ademA-GalNAc][mG]<br>[mG][mC][mU][mG][mC] | 423 | [MePhosphonate-4O-<br>mUs][fAs][fUs][fG][fC][mC]<br>[fA][mA][mU][fC][mC][mA]<br>[mG][fA][mC][mA][mA][mC]<br>[mG][mGs][mGs][mG] | 424 |
| 17 | [mUs][mU][mG][mU]<br>[mC][mU][mG][fG][fA]<br>[fU][fU][mG][mG][mC]<br>[mA][mU][mC][mC][mU]<br>[mA][mG][mC][mA][mG]<br>[mC][mC][mG][ademA-GalNAc]<br>[ademA-GalNAc][ademA-GalNAc][mG]<br>[mG][mC][mU][mG][mC] | 425 | [MePhosphonate-4O-<br>mUs][fAs][fGs][fG][fA][mU]<br>[fG][mC][mC][fA][mA][mU]<br>[mC][fC][mA][mG][mA][mC]<br>[mA][mAs][mGs][mG] | 426 |
| 18 | [mUs][mG][mU][mC]<br>[mU][mG][mG][fA][fU]<br>[fU][fG][mG][mC][mA]<br>[mU][mC][mC][mU][mG]<br>[mA][mG][mC][mA][mG]<br>[mC][mC][mG][ademA-GalNAc]<br>[ademA-GalNAc][ademA-GalNAc][mG]<br>[mG][mC][mU][mG][mC] | 427 | [MePhosphonate-4O-<br>mUs][fCs][fAs][fG][fG][mA]<br>[fU][mG][mC][fC][mA][mA]<br>[mU][fC][mC][mA][mG][mA]<br>[mC][mAs][mGs][mG] | 428 |
| 19 | [mGs][mU][mC][mU]<br>[mG][mG][mA][fU][fU]<br>[fG][fG][mC][mA][mU]<br>[mC][mC][mU][mG][mG] | 429 | [MePhosphonate-4O-<br>mUs][fCs][fCs][fA][fG][mG]<br>[fA][mU][mG][fC][mC][mA]<br>[mA][fU][mC][mC][mA][mG] | 430 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mA][mG][mC][mA][mG][mC][mC][mG][ademA-GalNAc][ademA-GalNAc][ademA-GalNAc][mG][mG][mC][mU][mG][mC] | | [mA][mCs][mGs][mG] | |
| 20 | [mCs][mU][mG][mG][mA][mU][mU][fG][fG][fC][fA][mU][mC][mC][mU][mG][mG][mU][mA][mA][mG][mC][mA][mG][mC][mC][mG][ademA-GalNAc][ademA-GalNAc][ademA-GalNAc][mG][mG][mC][mU][mG][mC] | 431 | [MePhosphonate-4O-mUs][fUs][fAs][fC][fC][mA][fG][mG][mA][fU][mG][mC][mC][fA][mA][mU][mC][mC][mA][mGs][mGs][mG] | 432 |
| 21 | [mUs][mG][mG][mA][mU][mU][mG][fG][fC][fA][fU][mC][mC][mU][mG][mG][mU][mA][mU][mA][mG][mC][mA][mG][mC][mC][mG][ademA-GalNAc][ademA-GalNAc][ademA-GalNAc][mG][mG][mC][mU][mG][mC] | 433 | [MePhosphonate-4O-mUs][fAs][fUs][fA][fC][mC][fA][mG][mG][fA][mU][mG][mC][fC][mA][mA][mU][mC][mC][mAs][mGs][mG] | 434 |
| 22 | [mGs][mG][mA][mU][mU][mG][mG][fC][fA][fU][fC][mC][mU][mG][mG][mU][mA][mU][mA][mA][mG][mC][mA][mG][mC][mC][mG][ademA-GalNAc][ademA-GalNAc][ademA-GalNAc][mG][mG][mC][mU][mG][mC] | 435 | [MePhosphonate-4O-mUs][fUs][fAs][fU][fA][mC][fC][mA][mG][fG][mA][mU][mG][fC][mC][mA][mA][mU][mC][mCs][mGs][mG] | 436 |
| 23 | [mGs][mA][mU][mU][mG][mG][mC][fA][fU][fC][fC][mU][mG][mG][mU][mA][mU][mA][mC][mA][mG][mC][mA][mG][mC][mC][mG][ademA-GalNAc][ademA-GalNAc][ademA-GalNAc][mG][mG][mC][mU][mG][mC] | 437 | [MePhosphonate-4O-mUs][fGs][fUs][fA][fU][mA][fC][mC][mA][fG][mG][mA][mU][fG][mC][mC][mA][mA][mU][mCs][mGs][mG] | 438 |
| 24 | [mAs][mU][mU][mG][mG][mC][mA][fU][fC][fC][fU][mG][mG][mU][mA][mU][mA][mC][mA][mA][mG][mC][mA][mG][mC][mC][mG][ademA-GalNAc][ademA-GalNAc][ademA-GalNAc][mG][mG][mC][mU][mG][mC] | 439 | [MePhosphonate-4O-mUs][fUs][fGs][fU][fA][mU][fA][mC][mC][fA][mG][mG][mA][fU][mG][mC][mC][mA][mA][mUs][mGs][mG] | 440 |
| 25 | [mCs][mU][mC][mC][mA][mU][mC][fU][fU][fC][fC][mC][mA][mC][mC][mU][mG][mA][mU][mA][mG][mC][mA][mG][mC][mC][mG][ademA-GalNAc][ademA-GalNAc][ademA-GalNAc][mG][mG][mC][mU][mG][mC] | 441 | [MePhosphonate-4O-mUs][fAs][fUs][fC][fA][mG][fG][mU][mG][fG][mG][mA][mA][fG][mA][mU][mG][mG][mA][mGs][mGs][mG] | 442 |
| 26 | [mCs][mA][mU][mC][mU][mG][mC][fC][fU][fG][fU][mG][mG][mG][mA][mU][mG][mU][mA][mA][mG][mC][mA][mG][mC][mC][mG][ademA-GalNAc][ademA-GalNAc][ademA-GalNAc][mG][mG][mC][mU][mG][mC] | 443 | [MePhosphonate-4O-mUs][fUs][fAs][fC][fA][mU][fC][mC][mC][fA][mC][mA][mG][fG][mC][mA][mG][mA][mU][mGs][mGs][mG] | 444 |
| 27 | [mUs][mC][mU][mG][mC][mC][mU][fG][fU][fG][fG][mG][mA][mU][mG][mU][mA][mC][mU][mA][mG][mC][mA][mG][mC][mC][mG][ademA-GalNAc][ademA-GalNAc][ademA-GalNAc][mG][mG][mC][mU][mG][mC] | 445 | [MePhosphonate-4O-mUs][fAs][fGs][fU][fA][mC][fA][mU][mC][fC][mC][mA][mC][fA][mG][mG][mC][mA][mG][mAs][mGs][mG] | 446 |
| 28 | [mGs][mU][mG][mG][mU][mG][mC][fA][fA][fG][fC][mU][mU][mG] | 447 | [MePhosphonate-4O-mUs][fAs][fCs][fA][fC][mC][fC][mA][mA][fG][mC][mU] | 448 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mG][mG][mU][mG][mU][mA][mG][mC][mA][mG][mC][mC][mG][ademA-GalNAc][ademA-GalNAc][ademA-GalNAc][mG][mG][mC][mU][mG][mC] | | [mU][fG][mC][mA][mC][mC][mA][mCs][mGs][mG] | |
| 29 | [mUs][mG][mG][mU][mG][mC][mA][fA][fG][fC][fU][mU][mG][mG][mG][mU][mG][mU][mC][mA][mG][mC][mA][mG][mC][mC][mG][ademA-GalNAc][ademA-GalNAc][ademA-GalNAc][mG][mG][mC][mU][mG][mC] | 449 | [MePhosphonate-4O-mUs][fGs][fAs][fC][fA][mC][fC][mC][mA][fA][mG][mC][mU][fU][mG][mC][mA][mC][mC][mAs][mGs][mG] | 450 |
| 30 | [mGs][mG][mU][mG][mC][mA][mA][fG][fC][fU][fU][mG][mG][mG][mU][mG][mU][mC][mA][mA][mG][mC][mA][mG][mC][mC][mG][ademA-GalNAc][ademA-GalNAc][ademA-GalNAc][mG][mG][mC][mU][mG][mC] | 451 | [MePhosphonate-4O-mUs][fUs][fGs][fA][fC][mA][fC][mC][mC][fA][mA][mG][mC][fU][mU][mG][mC][mA][mC][mCs][mGs][mG] | 452 |
| 31 | [mGs][mU][mG][mC][mA][mA][mG][fC][fU][fU][fG][mG][mG][mU][mG][mU][mC][mA][mU][mA][mG][mC][mA][mG][mC][mC][mG][ademA-GalNAc][ademA-GalNAc][ademA-GalNAc][mG][mG][mC][mU][mG][mC] | 453 | [MePhosphonate-4O-mUs][fAs][fUs][fG][fA][mC][fA][mC][mC][fC][mA][mA][mG][fC][mU][mU][mG][mC][mA][mCs][mGs][mG] | 454 |
| 32 | [mGs][mC][mA][mA][mG][mC][mU][fU][fG][fG][fG][mU][mG][mU][mC][mA][mU][mC][mU][mA][mG][mC][mA][mG][mC][mC][mG][ademA-GalNAc][ademA-GalNAc][ademA-GalNAc][mG][mG][mC][mU][mG][mC] | 455 | [MePhosphonate-4O-mUs][fAs][fGs][fA][fU][mG][fA][mC][mA][fC][mC][mC][mA][fA][mG][mC][mU][mU][mG][mCs][mGs][mG] | 456 |
| 33 | [mCs][mA][mA][mG][mC][mU][mU][fG][fG][fG][fU][mG][mU][mC][mA][mU][mC][mU][mC][mA][mG][mC][mA][mG][mC][mC][mG][ademA-GalNAc][ademA-GalNAc][ademA-GalNAc][mG][mG][mC][mU][mG][mC] | 457 | [MePhosphonate-4O-mUs][fGs][fAs][fG][fA][mU][fG][mA][mC][fA][mC][mC][mC][fA][mA][mG][mC][mU][mU][mGs][mGs][mG] | 458 |
| 34 | [mAs][mA][mG][mC][mU][mU][mG][fG][fG][fU][fG][mU][mC][mA][mU][mC][mU][mC][mA][mA][mG][mC][mA][mG][mC][mC][mG][ademA-GalNAc][ademA-GalNAc][ademA-GalNAc][mG][mG][mC][mU][mG][mC] | 459 | [MePhosphonate-4O-mUs][fUs][fGs][fA][fG][mA][fU][mG][mA][fC][mA][mC][mC][fC][mA][mA][mG][mC][mU][mUs][mGs][mG] | 460 |
| 35 | [mAs][mG][mC][mU][mU][mG][mG][fG][fU][fG][fU][mC][mA][mU][mC][mU][mC][mA][mG][mA][mG][mC][mA][mG][mC][mC][mG][ademA-GalNAc][ademA-GalNAc][ademA-GalNAc][mG][mG][mC][mU][mG][mC] | 461 | [MePhosphonate-4O-mUs][fCs][fUs][fG][fA][mG][fA][mU][mG][fA][mC][mA][mC][fC][mC][mA][mA][mG][mC][mUs][mGs][mG] | 462 |
| 36 | [mGs][mC][mU][mU][mG][mG][mG][fU][fG][fU][fC][mA][mU][mC][mU][mC][mA][mG][mA][mA][mG][mC][mA][mG][mC][mC][mG][ademA-GalNAc][ademA-GalNAc][ademA-GalNAc][mG][mG][mC][mU][mG][mC] | 463 | [MePhosphonate-4O-mUs][fUs][fCs][fU][fG][mA][fG][mA][mU][fG][mA][mC][mA][fC][mC][mC][mA][mA][mG][mCs][mGs][mG] | 464 |
| 37 | [mGs][mU][mG][mU][mC][mU][mC][fC][fU][fU][fU][mU][mG][mG][mG][mA][mC][mC][mU][mA][mG][mC][mA][mG] | 465 | [MePhosphonate-4O-mUs][fAs][fGs][fG][fU][mC][fC][mC][mA][fA][mA][mA][mG][fG][mA][mG][mA][mC][mA][mCs][mGs][mG] | 466 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mC][mG][ademA-GalNAc][ademA-GalNAc][ademA-GalNAc][mG][mG][mC][mU][mG][mC] | | | |
| 38 | [mUs][mG][mU][mC][mU][mC][mC][fU][fU][fU][fU][mG][mG][mG][mA][mC][mC][mU][mA][mA][mG][mC][mA][mG][mC][mC][mG][ademA-GalNAc][ademA-GalNAc][ademA-GalNAc][mG][mG][mC][mU][mG][mC] | 467 | [MePhosphonate-4O-mUs][fUs][fAs][fG][fG][mU][fC][mC][mC][fA][mA][mA][mA][fG][mG][mA][mG][mA][mC][mAs][mGs][mG] | 468 |
| 39 | [mGs][mG][mG][mG][mA][mC][mC][fU][fG][fU][fU][mA][mC][mA][mG][mA][mC][mA][mG][mA][mG][mC][mA][mG][mC][mC][mG][ademA-GalNAc][ademA-GalNAc][ademA-GalNAc][mG][mG][mC][mU][mG][mC] | 469 | [MePhosphonate-4O-mUs][fCs][fUs][fG][fU][mC][fU][mG][mU][fA][mA][mC][mA][fG][mG][mU][mC][mC][mC][mCs][mGs][mG] | 470 |
| 40 | [mGs][mG][mG][mA][mC][mC][mU][fG][fU][fU][fA][mC][mA][mG][mA][mC][mA][mG][mU][mA][mG][mC][mA][mG][mC][mC][mG][ademA-GalNAc][ademA-GalNAc][ademA-GalNAc][mG][mG][mC][mU][mG][mC] | 471 | [MePhosphonate-4O-mUs][fAs][fCs][fU][fG][mU][fC][mU][mG][fU][mA][mA][mC][fA][mG][mG][mU][mC][mC][mCs][mGs][mG] | 472 |
| 41 | [mGs][mG][mA][mC][mC][mU][mG][fU][fU][fA][fC][mA][mG][mA][mC][mA][mG][mU][mC][mA][mG][mC][mA][mG][mC][mC][mG][ademA-GalNAc][ademA-GalNAc][ademA-GalNAc][mG][mG][mC][mU][mG][mC] | 473 | [MePhosphonate-4O-mUs][fGs][fAs][fC][fU][mG][fU][mC][mU][fG][mU][mA][mA][fC][mA][mG][mG][mU][mC][mCs][mGs][mG] | 474 |
| 42 | [mGs][mA][mC][mC][mU][mG][mU][fU][fA][fC][fA][mG][mA][mC][mA][mG][mU][mC][mU][mA][mG][mC][mA][mG][mC][mC][mG][ademA-GalNAc][ademA-GalNAc][ademA-GalNAc][mG][mG][mC][mU][mG][mC] | 475 | [MePhosphonate-4O-mUs][fAs][fGs][fA][fC][mU][fG][mU][mC][fU][mG][mU][mA][fA][mC][mA][mG][mG][mU][mCs][mGs][mG] | 476 |
| 43 | [mAs][mC][mC][mU][mG][mU][mU][fA][fC][fA][fG][mA][mC][mA][mG][mU][mC][mU][mA][mA][mG][mC][mA][mG][mC][mC][mG][ademA-GalNAc][ademA-GalNAc][ademA-GalNAc][mG][mG][mC][mU][mG][mC] | 477 | [MePhosphonate-4O-mUs][fUs][fAs][fG][fA][mC][fU][mG][mU][fC][mU][mG][mU][fA][mA][mC][mA][mG][mG][mUs][mGs][mG] | 478 |
| 44 | [mUs][mG][mC][mC][mA][mU][mU][fG][fU][fC][fU][mG][mC][mA][mA][mC][mU][mU][mU][mA][mG][mC][mA][mG][mC][mC][mG][ademA-GalNAc][ademA-GalNAc][ademA-GalNAc][mG][mG][mC][mU][mG][mC] | 479 | [MePhosphonate-4O-mUs][fAs][fAs][fA][fG][mU][fU][mG][mC][fA][mG][mA][mC][fA][mA][mU][mG][mG][mC][mAs][mGs][mG] | 480 |
| 45 | [mGs][mC][mC][mA][mU][mU][mG][fU][fC][fU][fG][mC][mA][mA][mC][mU][mU][mU][mG][mA][mG][mC][mA][mG][mC][mC][mG][ademA-GalNAc][ademA-GalNAc][ademA-GalNAc][mG][mG][mC][mU][mG][mC] | 481 | [MePhosphonate-4O-mUs][fCs][fAs][fA][fA][mG][fU][mU][mG][fC][mA][mG][mA][fC][mA][mA][mU][mG][mG][mCs][mGs][mG] | 482 |
| 46 | [mCs][mC][mA][mU][mU][mG][mU][fC][fU][fG][fC][mA][mA][mC] | 483 | [MePhosphonate-4O-mUs][fCs][fCs][fA][fA][mA][fG][mU][mU][fG][mC][mA] | 484 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mU][mU][mU][mG][mG][mA][mG][mC][mA][mG][mC][mC][mG][ademA-GalNAc][ademA-GalNAc][ademA-GalNAc][mG][mG][mC][mU][mG][mC] | | [mG][fA][mC][mA][mA][mU][mG][mGs][mGs][mG] | |
| 47 | [mAs][mU][mU][mG][mU][mC][mU][fG][fC][fA][fA][mC][mU][mU][mU][mG][mG][mC][mA][mA][mG][mC][mA][mG][mC][mC][mG][ademA-GalNAc][ademA-GalNAc][ademA-GalNAc][mG][mG][mC][mU][mG][mC] | 485 | [MePhosphonate-4O-mUs][fUs][fGs][fC][fC][mA][fA][mA][mG][fU][mU][mG][mC][fA][mG][mA][mC][mA][mA][mUs][mGs][mG] | 486 |
| 48 | [mUs][mC][mU][mG][mC][mA][mA][fC][fU][fU][fU][mG][mG][mC][mA][mG][mU][mG][mA][mA][mG][mC][mA][mG][mC][mC][mG][ademA-GalNAc][ademA-GalNAc][ademA-GalNAc][mG][mG][mC][mU][mG][mC] | 487 | [MePhosphonate-4O-mUs][fUs][fCs][fA][fC][mU][fG][mC][mC][fA][mA][mA][mG][fU][mU][mG][mC][mA][mG][mAs][mGs][mG] | 488 |
| 49 | [mCs][mU][mA][mC][mC][mC][mA][fC][fU][fG][fC][mU][mG][mA][mA][mA][mC][mU][mC][mA][mG][mC][mA][mG][mC][mC][mG][ademA-GalNAc][ademA-GalNAc][ademA-GalNAc][mG][mG][mC][mU][mG][mC] | 489 | [MePhosphonate-4O-mUs][fGs][fAs][fG][fU][mU][fU][mC][mA][fG][mC][mA][mG][fU][mG][mG][mG][mU][mA][mGs][mGs][mG] | 490 |
| 50 | [mGs][mC][mC][mA][mG][mG][mA][fA][fC][fA][fG][mG][mA][mC][mC][mU][mG][mU][mG][mA][mG][mC][mA][mG][mC][mC][mG][ademA-GalNAc][ademA-GalNAc][ademA-GalNAc][mG][mG][mC][mU][mG][mC] | 491 | [MePhosphonate-4O-mUs][fCs][fAs][fC][fA][mG][fG][mU][mC][fC][mU][mG][mU][fU][mC][mC][mU][mG][mG][mCs][mGs][mG] | 492 |
| 51 | [mGs][mA][mA][mC][mA][mG][mG][fA][fC][fC][fU][mG][mU][mG][mG][mA][mA][mU][mU][mA][mG][mC][mA][mG][mC][mC][mG][ademA-GalNAc][ademA-GalNAc][ademA-GalNAc][mG][mG][mC][mU][mG][mC] | 493 | [MePhosphonate-4O-mUs][fAs][fAs][fU][fU][mC][fC][mA][mC][fA][mG][mG][mU][fC][mC][mU][mG][mU][mU][mCs][mGs][mG] | 494 |
| 52 | [mAs][mC][mA][mG][mG][mA][mC][fC][fU][fG][fU][mG][mG][mA][mA][mU][mU][mC][mA][mA][mG][mC][mA][mG][mC][mC][mG][ademA-GalNAc][ademA-GalNAc][ademA-GalNAc][mG][mG][mC][mU][mG][mC] | 495 | [MePhosphonate-4O-mUs][fUs][fGs][fA][fA][mU][fU][mC][mC][fA][mC][mA][mG][fG][mU][mC][mC][mU][mG][mUs][mGs][mG] | 496 |
| 53 | [mUs][mG][mG][mA][mA][mU][mU][fC][fA][fC][fC][mA][mC][mC][mC][mC][mU][mG][mU][mA][mG][mC][mA][mG][mC][mC][mG][ademA-GalNAc][ademA-GalNAc][ademA-GalNAc][mG][mG][mC][mU][mG][mC] | 497 | [MePhosphonate-4O-mUs][fAs][fCs][fA][fG][mG][fG][mG][mU][fG][mG][mU][mG][fA][mA][mU][mU][mC][mC][mAs][mGs][mG] | 498 |
| 54 | [mCs][mU][mU][mG][mU][mG][mA][fC][fC][fA][fC][mC][mU][mA][mC][mA][mU][mC][mA][mA][mG][mC][mA][mG][mC][mC][mG][ademA-GalNAc][ademA-GalNAc][ademA-GalNAc][mG][mG][mC][mU][mG][mC] | 499 | [MePhosphonate-4O-mUs][fUs][fGs][fA][fU][mG][fU][mA][mG][fG][mU][mG][mG][fU][mC][mA][mC][mA][mA][mGs][mGs][mG] | 500 |
| 55 | [mUs][mU][mG][mU][mG][mA][mC][fC][fA][fC][fC][mU][mA][mC][mA][mU][mC][mA][mU][mA][mG][mC][mA][mG] | 501 | [MePhosphonate-4O-mUs][fAs] [fUs][fG][fA][mU][fG][mU][mA][fG][mG][mU][mG][fG][mU][mC][mA][mC][mA][mAs][mGs][mG] | 502 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| 56 | [mC][mC][mG][ademA-GalNAc][ademA-GalNAc][ademA-GalNAc][mG][mG][mC][mU][mG][mC][mUs][mG][mU][mG][mA][mC][mC][fA][fC][fC][fU][mA][mC][mA][mU][mC][mA][mU][mC][mA][mG][mC][mA][mG] | 503 | [MePhosphonate-4O-mUs][fGs][fAs][fU][fG][mA][fU][mG][mU][fA][mG][mG][mU][fG][mG][mU][mC][mA][mC][mAs][mGs][mG] | 504 |
| 57 | [mC][mC][mG][ademA-GalNAc][ademA-GalNAc][ademA-GalNAc][mG][mG][mC][mU][mG][mC][mGs][mU][mG][mA][mC][mC][mA][fC][fC][fU][fA][mC][mA][mU][mC][mA][mU][mC][mU][mA][mG][mC][mA][mG] | 505 | [MePhosphonate-4O-mUs][fAs][fGs][fA][fU][mG][fA][mU][mG][fU][mA][mG][mG][fU][mG][mG][mU][mC][mA][mCs][mGs][mG] | 506 |
| 58 | [mC][mC][mG][ademA-GalNAc][ademA-GalNAc][ademA-GalNAc][mG][mG][mC][mU][mG][mC][mUs][mG][mA][mC][mC][mA][mC][fC][fU][fA][fC][mA][mU][mC][mA][mU][mC][mU][mU][mA][mG][mC][mA][mG] | 507 | [MePhosphonate-4O-mUs][fAs][fAs][fG][fA][mU][fG][mA][mU][fG][mU][mA][mG][fG][mU][mG][mG][mU][mC][mAs][mGs][mG] | 508 |
| 59 | [mC][mC][mG][ademA-GalNAc][ademA-GalNAc][ademA-GalNAc][mG][mG][mC][mU][mG][mC][mGs][mA][mC][mC][mA][mC][mC][fU][fA][fC][fA][mU][mC][mA][mU][mC][mU][mU][mG][mA][mG][mC][mA][mG] | 509 | [MePhosphonate-4O-mUs][fCs][fAs][fA][fG][mA][fU][mG][mA][fU][mG][mU][mA][fG][mG][mU][mG][mG][mU][mCs][mGs][mG] | 510 |
| 60 | [mC][mC][mG][ademA-GalNAc][ademA-GalNAc][ademA-GalNAc][mG][mG][mC][mU][mG][mC][mAs][mC][mC][mA][mC][mC][mU][fA][fC][fA][fU][mC][mA][mU][mC][mU][mU][mG][mU][mA][mG][mC][mA][mG] | 511 | [MePhosphonate-4O-mUs][fAs][fCs][fA][fA][mG][fA][mU][mG][fA][mU][mG][mU][fA][mG][mG][mU][mG][mG][mUs][mGs][mG] | 512 |
| 61 | [mC][mC][mG][ademA-GalNAc][ademA-GalNAc][ademA-GalNAc][mG][mG][mC][mU][mG][mC][mCs][mC][mA][mC][mC][mU][mA][fC][fA][fU][fC][mA][mU][mC][mU][mU][mG][mU][mU][mA][mG][mC][mA][mG] | 513 | [MePhosphonate-4O-mUs][fAs][fAs][fC][fA][mA][fG][mA][mU][fG][mA][mU][mG][fU][mA][mG][mG][mU][mG][mGs][mGs][mG] | 514 |
| 62 | [mC][mC][mG][ademA-GalNAc][ademA-GalNAc][ademA-GalNAc][mG][mG][mC][mU][mG][mC][mCs][mA][mC][mC][mU][mA][mC][fA][fU][fC][fA][mU][mC][mU][mU][mG][mU][mU][mU][mA][mG][mC][mA][mG] | 515 | [MePhosphonate-4O-mUs][fAs][fAs][fA][fC][mA][fA][mG][mA][fU][mG][mA][mU][fG][mU][mA][mG][mG][mU][mGs][mGs][mG] | 516 |
| 63 | [mC][mC][mG][ademA-GalNAc][ademA-GalNAc][ademA-GalNAc][mG][mG][mC][mU][mG][mC][mAs][mC][mC][mU][mA][mC][mA][fU][fC][fA][fU][mC][mU][mU][mG][mU][mU][mU][mG][mA][mG][mC][mA][mG] | 517 | [MePhosphonate-4O-mUs][fCs][fAs][fA][fA][mC][fA][mA][mG][fA][mU][mG][mA][fU][mG][mu][mA][mG][mG][mUs][mGs][mG] | 518 |
| 64 | [mC][mC][mG][ademA-GalNAc][ademA-GalNAc][ademA-GalNAc][mG][mG][mC][mU][mG][mC][mCs][mC][mU][mA][mC][mA][mU][fC][fA][fU][fC][mU][mU][mG] | 519 | [MePhosphonate-4O-mUs][fGs][fCs][fA][fA][mA][fC][mA][mA][fG][mA][mU] | 520 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mU][mU][mU][mG][mC] [mA][mG][mC][mA][mG] [mC][mC][mG][ademA-GalNAc] [ademA-GalNAc][ademA-GalNAc][mG] [mG][mC][mU][mG][mC] | | [mG][fA][mU][mG][mU][mA] [mG][mGs][mGs][mG] | |
| 65 | [mCs][mU][mA][mC] [mA][mU][mC][fA][fU] [fC][fU][mU][mG][mU] [mU][mU][mG][mC][mC] [mA][mG][mC][mA][mG] [mC][mC][mG][ademA-GalNAc] [ademA-GalNAc][ademA-GalNAc][mG] [mG][mC][mU][mG][mC] | 521 | [MePhosphonate-4O-mUs][fGs][fGs][fC][fA][mA] [fA][mC][mA][fA][mG][mA] [mU][fG][mA][mU][mG][mU] [mA][mGs][mGs][mG] | 522 |
| 66 | [mAs][mC][mA][mU] [mC][mA][mU][fC][fU] [fU][fG][mU][mU][mU] [mG][mC][mC][mU][mA] [mA][mG][mC][mA][mG] [mC][mC][mG][ademA-GalNAc] [ademA-GalNAc][ademA-GalNAc][mG] [mG][mC][mU][mG][mC] | 523 | [MePhosphonate-4O-mUs][fUs][fAs][fG][fG][mC] [fA][mA][mA][fC][mA][mA] [mG][fA][mU][mG][mA][mU] [mG][mUs][mGs][mG] | 524 |
| 67 | [mAs][mU][mC][mA] [mU][mC][mU][fU][fG] [fU][fU][mU][mG][mC] [mC][mU][mA][mC][mA] [mA][mG][mC][mA][mG] [mC][mC][mG][ademA-GalNAc] [ademA-GalNAc][ademA-GalNAc][mG] [mG][mC][mU][mG][mC] | 525 | [MePhosphonate-4O-mUs][fUs][fGs][fU][fA][mG] [fG][mC][mA][fA][mA][mC] [mA][fA][mG][mA][mU][mG] [mA][mUs][mGs][mG] | 526 |
| 68 | [mUs][mC][mA][mU] [mC][mU][mU][fG][fU] [fU][fU][mG][mC][mC] [mU][mA][mC][mA][mU] [mA][mG][mC][mA][mG] [mC][mC][mG][ademA-GalNAc] [ademA-GalNAc][ademA-GalNAc][mG] [mG][mC][mU][mG][mC] | 527 | [MePhosphonate-4O-mUs][fAs][fUs][fG][fU][mA] [fG][mG][mC][fA][mA][mA] [mC][fA][mA][mG][mA][mU] [mG][mAs][mGs][mG] | 528 |
| 69 | [mAs][mU][mC][mU] [mU][mG][mU][fU][fU] [fG][fC][mC][mU][mA] [mC][mA][mU][mC][mU] [mA][mG][mC][mA][mG] [mC][mC][mG][ademA-GalNAc] [ademA-GalNAc][ademA-GalNAc][mG] [mG][mC][mU][mG][mC] | 529 | [MePhosphonate-4O-mUs][fAs][fGs][fA][fU][mG] [fU][mA][mG][fG][mC][mA] [mA][fA][mC][mA][mA][mG] [mA][mUs][mGs][mG] | 530 |
| 70 | [mUs][mC][mU][mU] [mG][mU][mU][fU][fG] [fC][fC][mU][mA][mC] [mA][mU][mC][mU][mA] [mA][mG][mC][mA][mG] [mC][mC][mG][ademA-GalNAc] [ademA-GalNAc][ademA-GalNAc][mG] [mG][mC][mU][mG][mC] | 531 | [MePhosphonate-4O-mUs][fUs][fAs][fG][fA][mU] [fG][mU][mA][fG][mG][mC] [mA][fA][mA][mC][mA][mA] [mG][mAs][mGs][mG] | 532 |
| 71 | [mUs][mU][mU][mC] [mC][mC][mC][fU][fA] [fC][fC][mU][mU][mG] [mU][mG][mG][mU][mG] [mA][mG][mC][mA][mG] [mC][mC][mG][ademA-GalNAc] [ademA-GalNAc][ademA-GalNAc][mG] [mG][mC][mU][mG][mC] | 533 | [MePhosphonate-4O-mUs][fCs][fAs][fC][fC][mA] [fC][mA][mA][fG][mG][mU] [mA][fG][mG][mG][mG][mA] [mA][mAs][mGs][mG] | 534 |
| 72 | [mUs][mU][mC][mC] [mC][mC][mU][fA][fC] [fC][fU][mU][mG][mU] [mG][mG][mU][mG][mG] [mA][mG][mC][mA][mG] [mC][mC][mG][ademA-GalNAc] [ademA-GalNAc][ademA-GalNAc][mG] [mG][mC][mU][mG][mC] | 535 | [MePhosphonate-4O-mUs][fCs][fCs][fA][fC][mC] [fA][mC][mA][fA][mG][mG] [mU][fA][mG][mG][mG][mG] [mA][mAs][mGs][mG] | 536 |
| 73 | [mCs][mC][mC][mU] [mA][mC][mC][fU][fU] [fG][fU][mG][mG][mU] [mG][mG][mU][mU][mA] [mA][mG][mC][mA][mG] | 537 | [MePhosphonate-4O-mUs][fUs][fAs][fA][fC][mC] [fA][mC][mC][fA][mC][mA] [mA][fG][mG][mU][mA][mG] [mG][mGs][mGs][mG] | 538 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mC][mG][ademA-GalNAc][ademA-GalNAc][ademA-GalNAc][mG][mG][mC][mU][mG][mC] | | | |
| 74 | [mCs][mU][mA][mC][mC][mU][mU][fG][fU][fG][fG][mU][mG][mG][mU][mU][mA][mU][mU][mA][mG][mC][mA][mG][mC][mC][mG][ademA-GalNAc][ademA-GalNAc][ademA-GalNAc][mG][mG][mC][mU][mG][mC] | 539 | [MePhosphonate-4O-mUs][fAs][fAs][fU][fA][mA][fC][mC][mA][fC][mC][mA][mC][fA][mA][mG][mG][mU][mA][mGs][mGs][mG] | 540 |
| 75 | [mUs][mA][mC][mC][mU][mU][mG][fU][fG][fG][fU][mG][mG][mU][mU][mA][mU][mU][mG][mA][mG][mC][mA][mG][mC][mC][mG][ademA-GalNAc][ademA-GalNAc][ademA-GalNAc][mG][mG][mC][mU][mG][mC] | 541 | [MePhosphonate-4O-mUs][fCs][fAs][fA][fU][mA][fA][mC][mC][fA][mC][mC][mA][fC][mA][mA][mG][mG][mU][mAs][mGs][mG] | 542 |
| 76 | [mAs][mC][mC][mU][mU][mG][mU][fG][fG][fU][fG][mG][mU][mU][mA][mU][mU][mG][mG][mA][mG][mC][mA][mG][mC][mC][mG][ademA-GalNAc][ademA-GalNAc][ademA-GalNAc][mG][mG][mC][mU][mG][mC] | 543 | [MePhosphonate-4O-mUs][fCs][fCs][fA][fA][mU][fA][mA][mC][fC][mA][mC][mC][fA][mC][mA][mA][mG][mG][mUs][mGs][mG] | 544 |
| 77 | [mCs][mC][mU][mU][mG][mU][mG][fG][fU][fG][fG][mU][mU][mA][mU][mU][mG][mG][mG][mA][mG][mC][mA][mG][mC][mC][mG][ademA-GalNAc][ademA-GalNAc][ademA-GalNAc][mG][mG][mC][mU][mG][mC] | 545 | [MePhosphonate-4O-mUs][fCs][fCs][fC][fA][mA][fU][mA][mA][fC][mC][mA][mC][fC][mA][mC][mA][mA][mG][mGs][mGs][mG] | 546 |
| 78 | [mCs][mU][mU][mG][mU][mG][mG][fU][fG][fG][fU][mU][mA][mU][mU][mG][mG][mG][mU][mA][mG][mC][mA][mG][mC][mC][mG][ademA-GalNAc][ademA-GalNAc][ademA-GalNAc][mG][mG][mC][mU][mG][mC] | 547 | [MePhosphonate-4O-mUs][fAs][fCs][fC][fC][mA][fA][mU][mA][fA][mC][mC][mA][fC][mC][mA][mC][mA][mA][mGs][mGs][mG] | 548 |
| 79 | [mUs][mU][mG][mU][mG][mG][mU][fG][fG][fU][fU][mA][mU][mU][mG][mG][mG][mU][mU][mA][mG][mC][mA][mG][mC][mC][mG][ademA-GalNAc][ademA-GalNAc][ademA-GalNAc][mG][mG][mC][mU][mG][mC] | 549 | [MePhosphonate-4O-mUs][fAs][fAs][fC][fC][mC][fA][mA][mU][fA][mA][mC][mC][fA][mC][mC][mA][mC][mA][mAs][mGs][mG] | 550 |
| 80 | [mUs][mG][mU][mG][mG][mU][mG][fG][fU][fU][fA][mU][mU][mG][mG][mG][mU][mU][mA][mA][mG][mC][mA][mG][mC][mC][mG][ademA-GalNAc][ademA-GalNAc][ademA-GalNAc][mG][mG][mC][mU][mG][mC] | 551 | [MePhosphonate-4O-mUs][fUs][fAs][fA][fC][mC][fC][mA][mA][fU][mA][mA][mC][fC][mA][mC][mC][mA][mC][mAs][mGs][mG] | 552 |
| 81 | [mGs][mU][mG][mG][mU][mG][mG][fU][fU][fA][fU][mU][mG][mG][mG][mU][mU][mA][mG][mA][mG][mC][mA][mG][mC][mC][mG][ademA-GalNAc][ademA-GalNAc][ademA-GalNAc][mG][mG][mC][mU][mG][mC] | 553 | [MePhosphonate-4O-mUs][fCs][fUs][fA][fA][mC][fC][mC][mA][fA][mU][mA][mA][fC][mC][mA][mC][mC][mA][mCs][mGs][mG] | 554 |
| 82 | [mUs][mG][mG][mU][mG][mG][mU][fU][fA][fU][fU][mG][mG][mG] | 555 | [MePhosphonate-4O-mUs][fUs][fCs][fU][fA][mA][fC][mC][mC][fA][mA][mU] | 556 |

TABLE 4-continued

| GalXC™-SCAP Oligonucleotides (modified). | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| | [mU][mU][mA][mG][mA][mA][mG][mC][mA][mG][mC][mC][mG][ademA-GalNAc][ademA-GalNAc][ademA-GalNAc][mG][mG][mC][mU][mG][mC] | | [mA][fA][mC][mC][mA][mC][mC][mAs][mGs][mG] | |
| 83 | [mGs][mG][mU][mG][mG][mU][mU][fA][fU][fU][fG][mG][mG][mU][mU][mA][mG][mA][mG][mA][mG][mC][mA][mG][mC][mC][mG][ademA-GalNAc][ademA-GalNAc][ademA-GalNAc][mG][mG][mC][mU][mG][mC] | 557 | [MePhosphonate-4O-mUs][fCs][fUs][fC][fU][mA][fA][mC][mC][fC][mA][mA][mU][fA][mA][mC][mC][mA][mC][mCs][mGs][mG] | 558 |
| 84 | [mGs][mU][mG][mG][mU][mU][mA][fU][fU][fG][fG][mG][mU][mU][mA][mG][mA][mG][mA][mA][mG][mC][mA][mG][mC][mC][mG][ademA-GalNAc][ademA-GalNAc][ademA-GalNAc][mG][mG][mC][mU][mG][mC] | 559 | [MePhosphonate-4O-mUs][fUs][fCs][fU][fC][mU][fA][mA][mC][fC][mC][mA][mA][fU][mA][mA][mC][mC][mA][mCs][mGs][mG] | 560 |
| 85 | [mUs][mG][mG][mU][mU][mA][mU][fU][fG][fG][fG][mU][mU][mA][mG][mA][mG][mA][mA][mA][mG][mC][mA][mG][mC][mC][mG][ademA-GalNAc][ademA-GalNAc][ademA-GalNAc][mG][mG][mC][mU][mG][mC] | 561 | [MePhosphonate-4O-mUs][fUs][fUs][fC][fU][mC][fU][mA][mA][fC][mC][mC][mA][fA][mU][mA][mA][mC][mC][mAs][mGs][mG] | 562 |
| 86 | [mGs][mG][mU][mU][mA][mU][mU][fG][fG][fG][fU][mU][mA][mG][mA][mG][mA][mA][mU][mA][mG][mC][mA][mG][mC][mC][mG][ademA-GalNAc][ademA-GalNAc][ademA-GalNAc][mG][mG][mC][mU][mG][mC] | 563 | [MePhosphonate-4O-mUs][fAs][fUs][fU][fC][mU][fC][mU][mA][fA][mC][mC][mC][fA][mA][mU][mA][mA][mC][mCs][mGs][mG] | 564 |
| 87 | [mGs][mU][mU][mA][mU][mU][mG][fG][fG][fU][fU][mA][mG][mA][mG][mA][mA][mU][mG][mA][mG][mC][mA][mG][mC][mC][mG][ademA-GalNAc][ademA-GalNAc][ademA-GalNAc][mG][mG][mC][mU][mG][mC] | 565 | [MePhosphonate-4O-mUs][fCs][fAs][fU][fU][mC][fU][mC][mU][fA][mA][mC][mC][fC][mA][mA][mU][mA][mA][mCs][mGs][mG] | 566 |
| 88 | [mUs][mU][mA][mU][mU][mG][mG][fG][fU][fU][fA][mG][mA][mG][mA][mA][mU][mG][mU][mA][mG][mC][mA][mG][mC][mC][mG][ademA-GalNAc][ademA-GalNAc][ademA-GalNAc][mG][mG][mC][mU][mG][mC] | 567 | [MePhosphonate-4O-mUs][fAs][fCs][fA][fU][mU][fC][mU][mC][fU][mA][mA][mC][fC][mC][mA][mA][mU][mA][mAs][mGs][mG] | 568 |
| 89 | [mAs][mU][mU][mG][mG][mG][mU][fU][fA][fG][fA][mG][mA][mA][mU][mG][mU][mG][mU][mA][mG][mC][mA][mG][mC][mC][mG][ademA-GalNAc][ademA-GalNAc][ademA-GalNAc][mG][mG][mC][mU][mG][mC] | 569 | [MePhosphonate-4O-mUs][fAs][fCs][fA][fC][mA][fU][mU][mC][fU][mC][mU][mA][fA][mC][mC][mC][mA][mA][mUs][mGs][mG] | 570 |
| 90 | [mUs][mU][mG][mG][mG][mU][mU][fA][fG][fA][fG][mA][mA][mU][mG][mU][mG][mU][mU][mA][mG][mC][mA][mG][mC][mC][mG][ademA-GalNAc][ademA-GalNAc][ademA-GalNAc][mG][mG][mC][mU][mG][mC] | 571 | [MePhosphonate-4O-mUs][fAs][fAs][fC][fA][mC][fA][mU][mU][fC][mU][mC][mU][fA][mA][mC][mC][mC][mA][mAs][mGs][mG] | 572 |
| 91 | [mGs][mG][mU][mU][mA][mG][mA][fG][fA][fA][fU][mG][mU][mG][mU][mU][mG][mG][mU][mA][mG][mC][mA][mG] | 573 | [MePhosphonate-4O-mUs][fAs][fCs][fC][fA][mA][fC][mA][mC][fA][mU][mU][mC][fU][mC][mU][mA][mA][mC][mCs][mGs][mG] | 574 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mC][mG][ademA-GalNAc][ademA-GalNAc][ademA-GalNAc][mG][mG][mC][mU][mG][mC] | | | |
| 92 | [mGs][mU][mU][mA][mG][mA][mG][fA][fA][fU][fG][mU][mG][mU][mU][mG][mG][mU][mG][mA][mG][mC][mA][mG][mC][mC][mG][ademA-GalNAc][ademA-GalNAc][ademA-GalNAc][mG][mG][mC][mU][mG][mC] | 575 | [MePhosphonate-4O-mUs][fCs][fAs][fC][fC][mA][fA][mC][mA][fC][mA][mU][mU][fC][mU][mC][mU][mA][mA][mCs][mGs][mG] | 576 |
| 93 | [mUs][mU][mA][mG][mA][mG][mA][fA][fU][fG][fU][mG][mU][mU][mG][mG][mU][mG][mC][mA][mG][mC][mA][mG][mC][mC][mG][ademA-GalNAc][ademA-GalNAc][ademA-GalNAc][mG][mG][mC][mU][mG][mC] | 577 | [MePhosphonate-4O-mUs][fGs][fCs][fA][fC][mC][fA][mA][mC][fA][mC][mA][mU][fU][mC][mU][mC][mU][mA][mAs][mGs][mG] | 578 |
| 94 | [mUs][mA][mG][mA][mG][mA][mA][fU][fG][fU][fG][mU][mU][mG][mG][mU][mG][mC][mU][mA][mG][mC][mA][mG][mC][mC][mG][ademA-GalNAc][ademA-GalNAc][ademA-GalNAc][mG][mG][mC][mU][mG][mC] | 579 | [MePhosphonate-4O-mUs][fAs][fGs][fC][fA][mC][fC][mA][mA][fC][mA][mC][mA][fU][mU][mC][mU][mC][mU][mAs][mGs][mG] | 580 |
| 95 | [mAs][mG][mA][mG][mA][mA][mU][fG][fU][fG][fU][mU][mG][mG][mU][mG][mC][mU][mC][mA][mG][mC][mA][mG][mC][mC][mG][ademA-GalNAc][ademA-GalNAc][ademA-GalNAc][mG][mG][mC][mU][mG][mC] | 581 | [MePhosphonate-4O-mUs][fGs][fAs][fG][fC][mA][fC][mC][mA][fA][mC][mA][mC][fA][mU][mU][mC][mU][mC][mUs][mGs][mG] | 582 |
| 96 | [mGs][mA][mG][mA][mA][mU][mG][fU][fG][fU][fU][mG][mG][mU][mG][mC][mU][mC][mA][mA][mG][mC][mA][mG][mC][mC][mG][ademA-GalNAc][ademA-GalNAc][ademA-GalNAc][mG][mG][mC][mU][mG][mC] | 583 | [MePhosphonate-4O-mUs][fUs][fGs][fA][fG][mC][fA][mC][mC][fA][mA][mC][mA][fC][mA][mU][mU][mC][mU][mCs][mGs][mG] | 584 |
| 97 | [mAs][mG][mA][mA][mU][mG][mU][fG][fU][fU][fG][mG][mU][mG][mC][mU][mC][mA][mC][mA][mG][mC][mA][mG][mC][mC][mG][ademA-GalNAc][ademA-GalNAc][ademA-GalNAc][mG][mG][mC][mU][mG][mC] | 585 | [MePhosphonate-4O-mUs][fGs][fUs][fG][fA][mG][fC][mA][mC][fC][mA][mA][mC][fA][mC][mA][mU][mU][mC][mUs][mGs][mG] | 586 |
| 98 | [mAs][mA][mU][mG][mU][mG][mU][fU][fG][fG][fU][mG][mC][mU][mC][mA][mC][mC][mA][mA][mG][mC][mA][mG][mC][mC][mG][ademA-GalNAc][ademA-GalNAc][ademA-GalNAc][mG][mG][mC][mU][mG][mC] | 587 | [MePhosphonate-4O-mUs][fUs][fGs][fG][fU][mG][fA][mG][mC][fA][mC][mC][mA][fA][mC][mA][mC][mA][mU][mUs][mGs][mG] | 588 |
| 99 | [mAs][mU][mG][mU][mG][mU][mU][fG][fG][fU][fG][mC][mU][mC][mA][mC][mC][mA][mA][mA][mG][mC][mA][mG][mC][mC][mG][ademA-GalNAc][ademA-GalNAc][ademA-GalNAc][mG][mG][mC][mU][mG][mC] | 589 | [MePhosphonate-4O-mUs][fUs][fUs][fG][fG][mU][fG][mA][mG][fC][mA][mC][mC][fA][mA][mC][mA][mC][mA][mUs][mGs][mG] | 590 |
| 100 | [mUs][mG][mU][mG][mU][mU][mG][fG][fU][fG][fC][mU][mC][mA] | 591 | [MePhosphonate-4O-mUs][fCs][fUs][fU][fG][mG][fU][mG][mA][fG][mC][mA] | 592 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mC][mA][mA][mG][mA][mG][mC][mA][mG][mC][mC][mG][ademA-GalNAc][ademA-GalNAc][ademA-GalNAc][mG][mG][mC][mU][mG][mC] | | [mC][fC][mA][mA][mC][mA][mC][mAs][mGs][mG] | |
| 101 | [mUs][mG][mG][mU][mC][mC][mA][fU][fC][fA][fU][mG][mA][mA][mG][mA][mA][mC][mA][mA][mG][mC][mA][mG][mC][mC][mG][ademA-GalNAc][ademA-GalNAc][ademA-GalNAc][mG][mG][mC][mU][mG][mC] | 593 | [MePhosphonate-4O-mUs][fUs][fGs][fU][fU][mC][fU][mU][mC][fA][mU][mG][mA][fU][mG][mG][mA][mC][mC][mAs][mGs][mG] | 594 |
| 102 | [mGs][mG][mU][mC][mC][mA][mU][fC][fA][fU][fG][mA][mA][mG][mA][mA][mC][mA][mU][mA][mG][mC][mA][mG][mC][mC][mG][ademA-GalNAc][ademA-GalNAc][ademA-GalNAc][mG][mG][mC][mU][mG][mC] | 595 | [MePhosphonate-4O-mUs][fAs][fUs][fG][fU][mU][fC][mU][mU][fC][mA][mU][mG][fA][mU][mG][mG][mA][mC][mCs][mGs][mG] | 596 |
| 103 | [mCs][mU][mG][mA][mC][mU][mU][fC][fU][fU][fC][mC][mU][mU][mC][mA][mG][mA][mU][mA][mG][mC][mA][mG][mC][mC][mG][ademA-GalNAc][ademA-GalNAc][ademA-GalNAc][mG][mG][mC][mU][mG][mC] | 597 | [MePhosphonate-4O-mUs][fAs][fUs][fC][fU][mG][fA][mA][mG][fG][mA][mA][mG][fA][mA][mG][mU][mC][mA][mGs][mGs][mG] | 598 |
| 104 | [mAs][mC][mU][mU][mC][mU][mU][fC][fC][fU][fU][mC][mA][mG][mA][mU][mG][mC][mU][mA][mG][mC][mA][mG][mC][mC][mG][ademA-GalNAc][ademA-GalNAc][ademA-GalNAc][mG][mG][mC][mU][mG][mC] | 599 | [MePhosphonate-4O-mUs][fAs][fGs][fC][fA][mU][fC][mU][mG][fA][mA][mG][mG][fA][mA][mG][mA][mA][mG][mUs][mGs][mG] | 600 |
| 105 | [mUs][mC][mC][mU][mU][mC][mA][fG][fA][fU][fG][mC][mU][mG][mU][mU][mU][mU][mU][mA][mG][mC][mA][mG][mC][mC][mG][ademA-GalNAc][ademA-GalNAc][ademA-GalNAc][mG][mG][mC][mU][mG][mC] | 601 | [MePhosphonate-4O-mUs][fAs][fAs][fA][fA][mA][fC][mA][mG][fC][mA][mU][mC][fU][mG][mA][mA][mG][mG][mAs][mGs][mG] | 602 |
| 106 | [mCs][mC][mU][mU][mC][mA][mG][fA][fU][fG][fC][mU][mG][mU][mU][mU][mU][mU][mC][mA][mG][mC][mA][mG][mC][mC][mG][ademA-GalNAc][ademA-GalNAc][ademA-GalNAc][mG][mG][mC][mU][mG][mC] | 603 | [MePhosphonate-4O-mUs][fGs][fAs][fA][fA][mA][fA][mC][mA][fG][mC][mA][mU][fC][mU][mG][mA][mA][mG][mGs][mGs][mG] | 604 |
| 107 | [mCs][mU][mU][mC][mA][mG][mA][fU][fG][fC][fU][mG][mU][mU][mU][mU][mU][mC][mA][mA][mG][mC][mA][mG][mC][mC][mG][ademA-GalNAc][ademA-GalNAc][ademA-GalNAc][mG][mG][mC][mU][mG][mC] | 605 | [MePhosphonate-4O-mUs][fUs][fGs][fA][fA][mA][fA][mA][mC][fA][mG][mC][mA][fU][mC][mU][mG][mA][mA][mGs][mGs][mG] | 606 |
| 108 | [mUs][mU][mC][mA][mG][mA][mU][fG][fC][fU][fG][mU][mU][mU][mU][mU][mC][mA][mC][mA][mG][mC][mA][mG][mC][mC][mG][ademA-GalNAc][ademA-GalNAc][ademA-GalNAc][mG][mG][mC][mU][mG][mC] | 607 | [MePhosphonate-4O-mUs][fGs][fUs][fG][fA][mA][fA][mA][mA][fC][mA][mG][mC][fA][mU][mC][mU][mG][mA][mAs][mGs][mG] | 608 |
| 109 | [mCs][mA][mG][mA][mU][mG][mC][fU][fG][fU][fU][mU][mU][mU][mC][mA][mC][mC][mA][mA][mG][mC][mA][mG] | 609 | [MePhosphonate-4O-mUs][fUs][fGs][fG][fU][mG][fA][mA][mA][fA][mA][mC][mA][fG][mC][mA][mU][mC][mU][mGs][mGs][mG] | 610 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mC][mG][ademA-GalNAc][ademA-GalNAc][ademA-GalNAc][mG][mG][mC][mU][mG][mC] | | | |
| 110 | [mAs][mG][mA][mU][mG][mC][mU][fG][fU][fU][fU][mU][mU][mC][mA][mC][mC][mA][mC][mA][mG][mC][mA][mG][mC][mC][mG][ademA-GalNAc][ademA-GalNAc][ademA-GalNAc][mG][mG][mC][mU][mG][mC] | 611 | [MePhosphonate-4O-mUs][fGs][fUs][fG][fG][mU][fG][mA][mA][fA][mA][mA][mC][fA][mG][mC][mA][mU][mC][mUs][mGs][mG] | 612 |
| 111 | [mGs][mA][mU][mG][mC][mU][mG][fU][fU][fU][fU][mU][mC][mA][mC][mC][mA][mC][mU][mA][mG][mC][mA][mG][mC][mC][mG][ademA-GalNAc][ademA-GalNAc][ademA-GalNAc][mG][mG][mC][mU][mG][mC] | 613 | [MePhosphonate-4O-mUs][fAs][fGs][fU][fG][mG][fU][mG][mA][fA][mA][mA][mA][fC][mA][mG][mC][mA][mU][mCs][mGs][mG] | 614 |
| 112 | [mAs][mU][mG][mC][mU][mG][mU][fU][fU][fU][fU][mC][mA][mC][mC][mA][mC][mU][mG][mA][mG][mC][mA][mG][mC][mC][mG][ademA-GalNAc][ademA-GalNAc][ademA-GalNAc][mG][mG][mC][mU][mG][mC] | 615 | [MePhosphonate-4O-mUs][fCs][fAs][fG][fU][mG][fG][mU][mG][fA][mA][mA][mA][fA][mC][mA][mG][mC][mA][mUs][mGs][mG] | 616 |
| 113 | [mUs][mG][mC][mU][mG][mU][mU][fU][fU][fU][fC][mA][mC][mC][mA][mC][mU][mG][mU][mA][mG][mC][mA][mG][mC][mC][mG][ademA-GalNAc][ademA-GalNAc][ademA-GalNAc][mG][mG][mC][mU][mG][mC] | 617 | [MePhosphonate-4O-mUs][fAs][fCs][fA][fG][mU][fG][mG][mU][fG][mA][mA][mA][fA][mA][mC][mA][mG][mC][mAs][mGs][mG] | 618 |
| 114 | [mGs][mC][mU][mG][mU][mU][mU][fU][fU][fC][fA][mC][mC][mA][mC][mU][mG][mU][mC][mA][mG][mC][mA][mG][mC][mC][mG][ademA-GalNAc][ademA-GalNAc][ademA-GalNAc][mG][mG][mC][mU][mG][mC] | 619 | [MePhosphonate-4O-mUs][fGs][fAs][fC][fA][mG][fU][mG][mG][fU][mG][mA][mA][fA][mA][mA][mC][mA][mG][mCs][mGs][mG] | 620 |
| 115 | [mUs][mG][mU][mU][mU][mU][mU][fC][fA][fC][fC][mA][mC][mU][mG][mU][mC][mC][mU][mA][mG][mC][mA][mG][mC][mC][mG][ademA-GalNAc][ademA-GalNAc][ademA-GalNAc][mG][mG][mC][mU][mG][mC] | 621 | [MePhosphonate-4O-mUs][fAs][fGs][fG][fA][mC][fA][mG][mU][fG][mG][mU][mG][fA][mA][mA][mA][mA][mC][mAs][mGs][mG] | 622 |
| 116 | [mGs][mU][mU][mU][mU][mU][mC][fA][fC][fC][fA][mC][mU][mG][mU][mC][mC][mU][mG][mA][mG][mC][mA][mG][mC][mC][mG][ademA-GalNAc][ademA-GalNAc][ademA-GalNAc][mG][mG][mC][mU][mG][mC] | 623 | [MePhosphonate-4O-mUs][fCs][fAs][fG][fG][mA][fC][mA][mG][fU][mG][mG][mU][fG][mA][mA][mA][mA][mA][mCs][mGs][mG] | 624 |
| 117 | [mUs][mU][mU][mU][mU][mC][mA][fC][fC][fA][fC][mU][mG][mU][mC][mC][mU][mG][mU][mA][mG][mC][mA][mG][mC][mC][mG][ademA-GalNAc][ademA-GalNAc][ademA-GalNAc][mG][mG][mC][mU][mG][mC] | 625 | [MePhosphonate-4O-mUs][fAs][fCs][fA][fG][mG][fA][mC][mA][fG][mU][mG][mG][fU][mG][mA][mA][mA][mA][mAs][mGs][mG] | 626 |
| 118 | [mUs][mU][mU][mU][mC][mA][mC][fC][fA][fC][fU][mG][mU][mC] | 627 | [MePhosphonate-4O-mUs][fGs][fAs][fC][fA][mG][fG][mA][mC][fA][mG][mU] | 628 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mU][mG][mU][mC][mA][mG][mC][mA][mG][mC][mC][mG][ademA-GalNAc][ademA-GalNAc][ademA-GalNAc][mG][mG][mC][mU][mG][mC] | | [mG][fG][mU][mG][mA][mA][mA][mAs][mGs][mG] | |
| 119 | [mUs][mU][mC][mA][mC][mC][mA][fC][fU][fG][fU][mC][mC][mU][mG][mU][mC][mC][mA][mA][mG][mC][mA][mG][mC][mC][mG][ademA-GalNAc][ademA-GalNAc][ademA-GalNAc][mG][mG][mC][mU][mG][mC] | 629 | [MePhosphonate-4O-mUs][fUs][fGs][fG][fA][mC][fA][mG][mG][fA][mC][mA][mG][fU][mG][mG][mU][mG][mA][mAs][mGs][mG] | 630 |
| 120 | [mCs][mA][mC][mC][mA][mC][mU][fG][fU][fC][fC][mU][mG][mU][mC][mC][mA][mU][mU][mA][mG][mC][mA][mG][mC][mC][mG][ademA-GalNAc][ademA-GalNAc][ademA-GalNAc][mG][mG][mC][mU][mG][mC] | 631 | [MePhosphonate-4O-mUs][fAs][fAs][fU][fG][mG][fA][mC][mA][fG][mG][mA][mC][fA][mG][mU][mG][mG][mU][mGs][mGs][mG] | 632 |
| 121 | [mAs][mC][mC][mA][mC][mU][mG][fU][fC][fC][fU][mG][mU][mC][mC][mA][mU][mU][mG][mA][mG][mC][mA][mG][mC][mC][mG][ademA-GalNAc][ademA-GalNAc][ademA-GalNAc][mG][mG][mC][mU][mG][mC] | 633 | [MePhosphonate-4O-mUs][fCs][fAs][fA][fU][mG][fG][mA][mC][fA][mG][mG][mA][fC][mA][mG][mU][mG][mG][mUs][mGs][mG] | 634 |
| 122 | [mCs][mC][mA][mC][mU][mG][mU][fC][fC][fU][fG][mU][mC][mC][mA][mU][mU][mG][mA][mA][mG][mC][mA][mG][mC][mC][mG][ademA-GalNAc][ademA-GalNAc][ademA-GalNAc][mG][mG][mC][mU][mG][mC] | 635 | [MePhosphonate-4O-mUs][fUs][fCs][fA][fA][mU][fG][mG][mA][fC][mA][mG][mG][fA][mC][mA][mG][mU][mG][mGs][mGs][mG] | 636 |
| 123 | [mCs][mA][mC][mU][mG][mU][mC][fC][fU][fG][fU][mC][mC][mA][mU][mU][mG][mA][mC][mA][mG][mC][mA][mG][mC][mC][mG][ademA-GalNAc][ademA-GalNAc][ademA-GalNAc][mG][mG][mC][mU][mG][mC] | 637 | [MePhosphonate-4O-mUs][fGs][fUs][fC][fA][mA][fU][mG][mG][fA][mC][mA][mG][fG][mA][mC][mA][mG][mU][mGs][mGs][mG] | 638 |
| 124 | [mAs][mC][mU][mG][mU][mC][mC][fU][fG][fU][fC][mC][mA][mU][mU][mG][mA][mC][mA][mA][mG][mC][mA][mG][mC][mC][mG][ademA-GalNAc][ademA-GalNAc][ademA-GalNAc][mG][mG][mC][mU][mG][mC] | 639 | [MePhosphonate-4O-mUs][fUs][fGs][fU][fC][mA][fA][mU][mG][fG][mA][mC][mA][fG][mG][mA][mC][mA][mG][mUs][mGs][mG] | 640 |
| 125 | [mCs][mU][mA][mA][mG][mC][mU][fA][fC][fC][fU][mG][mA][mG][mA][mA][mC][mC][mA][mA][mG][mC][mA][mG][mC][mC][mG][ademA-GalNAc][ademA-GalNAc][ademA-GalNAc][mG][mG][mC][mU][mG][mC] | 641 | [MePhosphonate-4O-mUs][fUs][fGs][fG][fU][mU][fC][mU][mC][fA][mG][mG][mU][fA][mG][mC][mU][mU][mA][mGs][mGs][mG] | 642 |
| 126 | [mGs][mA][mG][mG][mU][mC][mC][fA][fG][fC][fA][mG][mA][mG][mG][mU][mU][mG][mU][mA][mG][mC][mA][mG][mC][mC][mG][ademA-GalNAc][ademA-GalNAc][ademA-GalNAc][mG][mG][mC][mU][mG][mC] | 643 | [MePhosphonate-4O-mUs][fAs][fCs][fA][fA][mC][fC][mU][mC][fU][mG][mC][mU][fG][mG][mA][mC][mC][mU][mCs][mGs][mG] | 644 |
| 127 | [mGs][mC][mA][mG][mA][mG][mG][fU][fU][fG][fU][mC][mC][mA][mU][mG][mA][mC][mA][mA][mG][mC][mA][mG] | 645 | [MePhosphonate-4O-mUs][fUs][fGs][fU][fC][mA][fU][mG][mG][fA][mC][mA][mA][fC][mC][mU][mC][mU][mG][mCs][mGs][mG] | 646 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mC][mG][ademA-GalNAc][ademA-GalNAc][ademA-GalNAc][mG][mG][mC][mU][mG][mC] | | | |
| 128 | [mCs][mA][mG][mA][mG][mG][mU][fU][fG][fU][fC][mC][mA][mU][mG][mA][mC][mA][mG][mA][mG][mC][mA][mG][mC][mC][mG][ademA-GalNAc][ademA-GalNAc][ademA-GalNAc][mG][mG][mC][mU][mG][mC] | 647 | [MePhosphonate-4O-mUs][fCs][fUs][fG][fU][mC][fA][mU][mG][fG][mA][mC][mA][fA][mC][mC][mU][mC][mU][mGs][mGs][mG] | 648 |
| 129 | [mGs][mA][mG][mG][mA][mU][mG][fA][fG][fG][fA][mA][mC][mU][mU][mU][mG][mG][mA][mA][mG][mC][mA][mG][mC][mC][mG][ademA-GalNAc][ademA-GalNAc][ademA-GalNAc][mG][mG][mC][mU][mG][mC] | 649 | [MePhosphonate-4O-mUs][fUs][fCs][fC][fA][mA][fA][mG][mU][fU][mC][mC][mU][fC][mA][mU][mC][mC][mU][mCs][mGs][mG] | 650 |
| 130 | [mGs][mA][mA][mC][mU][mU][mU][fG][fG][fA][fG][mG][mA][mA][mA][mU][mU][mG][mU][mA][mG][mC][mA][mG][mC][mC][mG][ademA-GalNAc][ademA-GalNAc][ademA-GalNAc][mG][mG][mC][mU][mG][mC] | 651 | [MePhosphonate-4O-mUs][fAs][fCs][fA][fA][mU][fU][mU][mC][fC][mU][mC][mC][fA][mA][mA][mG][mU][mU][mCs][mGs][mG] | 652 |
| 131 | [mGs][mA][mC][mG][mC][mU][mC][fU][fU][fC][fA][mG][mC][mU][mA][mU][mU][mA][mC][mA][mG][mC][mA][mG][mC][mC][mG][ademA-GalNAc][ademA-GalNAc][ademA-GalNAc][mG][mG][mC][mU][mG][mC] | 653 | [MePhosphonate-4O-mUs][fGs][fUs][fA][fA][mU][fA][mG][mC][fU][mG][mA][mA][fG][mA][mG][mC][mG][mU][mCs][mGs][mG] | 654 |
| 132 | [mAs][mC][mG][mC][mU][mC][mU][fU][fC][fA][fG][mC][mU][mA][mU][mU][mA][mC][mA][mA][mG][mC][mA][mG][mC][mC][mG][ademA-GalNAc][ademA-GalNAc][ademA-GalNAc][mG][mG][mC][mU][mG][mC] | 655 | [MePhosphonate-4O-mUs][fUs][fGs][fU][fA][mA][fU][mA][mG][fC][mU][mG][mA][fA][mG][mA][mG][mC][mG][mUs][mGs][mG] | 656 |
| 133 | [mCs][mG][mC][mU][mC][mU][mU][fC][fA][fG][fC][mU][mA][mU][mU][mA][mC][mA][mA][mA][mG][mC][mA][mG][mC][mC][mG][ademA-GalNAc][ademA-GalNAc][ademA-GalNAc][mG][mG][mC][mU][mG][mC] | 657 | [MePhosphonate-4O-mUs][fUs][fUs][fG][fU][mA][fA][mU][mA][fG][mC][mU][mG][fA][mA][mG][mA][mG][mC][mGs][mGs][mG] | 658 |
| 134 | [mGs][mC][mU][mC][mU][mU][mC][fA][fG][fC][fU][mA][mU][mU][mA][mC][mA][mA][mC][mA][mG][mC][mA][mG][mC][mC][mG][ademA-GalNAc][ademA-GalNAc][ademA-GalNAc][mG][mG][mC][mU][mG][mC] | 659 | [MePhosphonate-4O-mUs][fGs][fUs][fU][fG][mU][fA][mA][mU][fA][mG][mC][mU][fG][mA][mA][mG][mA][mG][mCs][mGs][mG] | 660 |
| 135 | [mCs][mU][mC][mU][mU][mC][mA][fG][fC][fU][fA][mU][mU][mA][mC][mA][mA][mC][mA][mA][mG][mC][mA][mG][mC][mC][mG][ademA-GalNAc][ademA-GalNAc][ademA-GalNAc][mG][mG][mC][mU][mG][mC] | 661 | [MePhosphonate-4O-mUs][fUs][fGs][fU][fU][mG][fU][mA][mA][fU][mA][mG][mC][fU][mG][mA][mA][mG][mA][mGs][mGs][mG] | 662 |
| 136 | [mUs][mC][mU][mU][mC][mA][mG][fC][fU][fA][fU][mU][mA][mC] | 663 | [MePhosphonate-4O-mUs][fAs][fUs][fG][fU][mU][fG][mU][mA][fA][mU][mA] | 664 |

TABLE 4-continued

| GalXC ™-SCAP Oligonucleotides (modified). | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| | [mA][mA][mC][mA][mU][mA][mG][mC][mA][mG][mC][mC][mG][ademA-GalNAc][ademA-GalNAc][ademA-GalNAc][mG][mG][mC][mU][mG][mC] | | [mG][fC][mU][mG][mA][mA][mG][mAs][mGs][mG] | |
| 137 | [mCs][mU][mU][mC][mA][mG][mC][fU][fA][fU][fU][mA][mC][mA][mA][mC][mA][mU][mC][mA][mG][mC][mA][mG][mC][mC][mG][ademA-GalNAc][ademA-GalNAc][ademA-GalNAc][mG][mG][mC][mU][mG][mC] | 665 | [MePhosphonate-4O-mUs][fGs][fAs][fU][fG][mU][fU][mG][mU][fA][mA][mU][mA][fG][mC][mU][mG][mA][mA][mGs][mGs][mG] | 666 |
| 138 | [mUs][mU][mC][mA][mG][mC][mU][fA][fU][fU][fA][mC][mA][mA][mC][mA][mU][mC][mA][mA][mG][mC][mA][mG][mC][mC][mG][ademA-GalNAc][ademA-GalNAc][ademA-GalNAc][mG][mG][mC][mU][mG][mC] | 667 | [MePhosphonate-4O-mUs][fUs][fGs][fA][fU][mG][fU][mU][mG][fU][mA][mA][mU][fA][mG][mC][mU][mG][mA][mAs][mGs][mG] | 668 |
| 139 | [mCs][mC][mA][mG][mC][mC][mU][fG][fA][fC][fC][mU][mC][mA][mC][mC][mU][mG][mC][mA][mG][mC][mA][mG][mC][mC][mG][ademA-GalNAc][ademA-GalNAc][ademA-GalNAc][mG][mG][mC][mU][mG][mC] | 669 | [MePhosphonate-4O-mUs][fGs][fCs][fA][fG][mG][fU][mG][mA][fG][mG][mU][mC][fA][mG][mG][mC][mU][mG][mGs][mGs][mG] | 670 |
| 140 | [mCs][mA][mG][mC][mC][mU][mG][fA][fC][fC][fU][mC][mA][mC][mC][mU][mG][mC][mU][mA][mG][mC][mA][mG][mC][mC][mG][ademA-GalNAc][ademA-GalNAc][ademA-GalNAc][mG][mG][mC][mU][mG][mC] | 671 | [MePhosphonate-4O-mUs][fAs][fGs][fC][fA][mG][fG][mU][mG][fA][mG][mG][mU][fC][mA][mG][mG][mC][mU][mGs][mGs][mG] | 672 |
| 141 | [mAs][mG][mC][mC][mU][mG][mA][fC][fC][fU][fC][mA][mC][mC][mU][mG][mC][mU][mU][mA][mG][mC][mA][mG][mC][mC][mG][ademA-GalNAc][ademA-GalNAc][ademA-GalNAc][mG][mG][mC][mU][mG][mC] | 673 | [MePhosphonate-4O-mUs][fAs][fAs][fG][fC][mA][fG][mG][mU][fG][mA][mG][mG][fU][mC][mA][mG][mG][mC][mUs][mGs][mG] | 674 |
| 142 | [mGs][mC][mC][mU][mG][mA][mC][fC][fU][fC][fA][mC][mC][mU][mG][mC][mU][mU][mA][mA][mG][mC][mA][mG][mC][mC][mG][ademA-GalNAc][ademA-GalNAc][ademA-GalNAc][mG][mG][mC][mU][mG][mC] | 675 | [MePhosphonate-4O-mUs][fUs][fAs][fA][fG][mC][fA][mG][mG][fU][mG][mA][mG][fG][mU][mC][mA][mG][mG][mCs][mGs][mG] | 676 |
| 143 | [mCs][mC][mU][mG][mA][mC][mC][fU][fC][fA][fC][mC][mU][mG][mC][mU][mU][mA][mA][mA][mG][mC][mA][mG][mC][mC][mG][ademA-GalNAc][ademA-GalNAc][ademA-GalNAc][mG][mG][mC][mU][mG][mC] | 677 | [MePhosphonate-4O-mUs][fUs][fUs][fA][fA][mG][fC][mA][mG][fG][mU][mG][mA][fG][mG][mU][mC][mA][mG][mGs][mGs][mG] | 678 |
| 144 | [mCs][mU][mG][mA][mC][mC][mU][fC][fA][fC][fC][mU][mG][mC][mU][mU][mA][mA][mU][mA][mG][mC][mA][mG][mC][mC][mG][ademA-GalNAc][ademA-GalNAc][ademA-GalNAc][mG][mG][mC][mU][mG][mC] | 679 | [MePhosphonate-4O-mUs][fAs][fUs][fU][fA][mA][fG][mC][mA][fG][mG][mU][mG][fA][mG][mG][mU][mC][mA][mGs][mGs][mG] | 680 |
| 145 | [mUs][mG][mA][mC][mC][mU][mC][fA][fC][fC][fU][mG][mC][mU][mU][mA][mA][mU][mU][mA][mG][mC][mA][mG] | 681 | [MePhosphonate-4O-mUs][fAs][fAs][fU][fU][mA][fA][mG][mC][fA][mG][mG][mU][fG][mA][mG][mG][mU][mC][mAs][mGs][mG] | 682 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mC][mG][ademA-GalNAc][ademA-GalNAc][ademA-GalNAc][mG][mG][mC][mU][mG][mC] | | | |
| 146 | [mGs][mA][mC][mC][mU][mC][mA][fC][fC][fU][fG][mC][mU][mU][mA][mA][mU][mU][mG][mA][mG][mC][mA][mG][mC][mC][mG][ademA-GalNAc][ademA-GalNAc][ademA-GalNAc][mG][mG][mC][mU][mG][mC] | 683 | [MePhosphonate-4O-mUs][fCs][fAs][fA][fU][mU][fA][mA][mG][fC][mA][mG][mG][fU][mG][mA][mG][mG][mU][mCs][mGs][mG] | 684 |
| 147 | [mAs][mC][mC][mU][mC][mA][mC][fC][fU][fG][fC][mU][mU][mA][mA][mU][mU][mG][mA][mA][mG][mC][mA][mG][mC][mC][mG][ademA-GalNAc][ademA-GalNAc][ademA-GalNAc][mG][mG][mC][mU][mG][mC] | 685 | [MePhosphonate-4O-mUs][fUs][fCs][fA][fA][mU][fU][mA][mA][fG][mC][mA][mG][fG][mU][mG][mA][mG][mG][mUs][mGs][mG] | 686 |
| 148 | [mCs][mC][mU][mC][mA][mC][mC][fU][fG][fC][fU][mU][mA][mA][mU][mU][mG][mA][mC][mA][mG][mC][mA][mG][mC][mC][mG][ademA-GalNAc][ademA-GalNAc][ademA-GalNAc][mG][mG][mC][mU][mG][mC] | 687 | [MePhosphonate-4O-mUs][fGs][fUs][fC][fA][mA][fU][mU][mA][fA][mG][mC][mA][fG][mG][mU][mG][mA][mG][mGs][mGs][mG] | 688 |
| 149 | [mCs][mU][mC][mA][mC][mC][mU][fG][fC][fU][fU][mA][mA][mU][mU][mG][mA][mC][mA][mA][mG][mC][mA][mG][mC][mC][mG][ademA-GalNAc][ademA-GalNAc][ademA-GalNAc][mG][mG][mC][mU][mG][mC] | 689 | [MePhosphonate-4O-mUs][fUs][fGs][fU][fC][mA][fA][mU][mU][fA][mA][mG][mC][fA][mG][mG][mU][mG][mA][mGs][mGs][mG] | 690 |
| 150 | [mUs][mC][mA][mC][mC][mU][mG][fC][fU][fU][fA][mA][mU][mU][mG][mA][mC][mA][mC][mA][mG][mC][mA][mG][mC][mC][mG][ademA-GalNAc][ademA-GalNAc][ademA-GalNAc][mG][mG][mC][mU][mG][mC] | 691 | [MePhosphonate-4O-mUs][fGs][fUs][fG][fU][mC][fA][mA][mU][fU][mA][mA][mG][fC][mA][mG][mG][mU][mG][mAs][mGs][mG] | 692 |
| 151 | [mCs][mA][mC][mC][mU][mG][mC][fU][fU][fA][fA][mU][mU][mG][mA][mC][mA][mC][mC][mA][mG][mC][mA][mG][mC][mC][mG][ademA-GalNAc][ademA-GalNAc][ademA-GalNAc][mG][mG][mC][mU][mG][mC] | 693 | [MePhosphonate-4O-mUs][fGs][fGs][fU][fG][mU][fC][mA][mA][fU][mU][mA][mA][fG][mC][mA][mG][mG][mU][mGs][mGs][mG] | 694 |
| 152 | [mAs][mC][mC][mU][mG][mC][mU][fU][fA][fA][fU][mU][mG][mA][mC][mA][mC][mC][mA][mA][mG][mC][mA][mG][mC][mC][mG][ademA-GalNAc][ademA-GalNAc][ademA-GalNAc][mG][mG][mC][mU][mG][mC] | 695 | [MePhosphonate-4O-mUs][fUs][fGs][fG][fU][mG][fU][mC][mA][fA][mU][mU][mA][fA][mG][mC][mA][mG][mG][mUs][mGs][mG] | 696 |
| 153 | [mCs][mC][mU][mG][mC][mU][mU][fA][fA][fU][fU][mG][mA][mC][mA][mC][mC][mA][mA][mA][mG][mC][mA][mG][mC][mC][mG][ademA-GalNAc][ademA-GalNAc][ademA-GalNAc][mG][mG][mC][mU][mG][mC] | 697 | [MePhosphonate-4O-mUs][fUs][fUs][fG][fG][mU][fG][mU][mC][fA][mA][mU][mU][fA][mA][mG][mC][mA][mG][mGs][mGs][mG] | 698 |
| 154 | [mCs][mU][mG][mC][mU][mU][mA][fA][fU][fU][fG][mA][mC][mA] | 699 | [MePhosphonate-4O-mUs][fGs][fUs][fU][fG][mG][fU][mG][mU][fC][mA][mA] | 700 |

TABLE 4-continued

| GalXC™-SCAP Oligonucleotides (modified). | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| | [mC][mC][mA][mA][mC][mA][mG][mC][mA][mG][mC][mC][mG][ademA-GalNAc][ademA-GalNAc][ademA-GalNAc][mG][mG][mC][mU][mG][mC] | | [mU][fU][mA][mA][mG][mC][mA][mGs][mGs][mG] | |
| 155 | [mUs][mG][mC][mU][mU][mA][mA][fU][fU][fG][fA][mC][mA][mC][mC][mA][mA][mC][mU][mA][mG][mC][mA][mG][mC][mC][mG][ademA-GalNAc][ademA-GalNAc][ademA-GalNAc][mG][mG][mC][mU][mG][mC] | 701 | [MePhosphonate-4O-mUs][fAs][fGs][fU][fU][mG][fG][mU][mG][fU][mC][mA][mA][fU][mU][mA][mA][mG][mC][mAs][mGs][mG] | 702 |
| 156 | [mGs][mC][mU][mU][mA][mA][mU][fU][fG][fA][fC][mA][mC][mC][mA][mA][mC][mU][mU][mA][mG][mC][mA][mG][mC][mC][mG][ademA-GalNAc][ademA-GalNAc][ademA-GalNAc][mG][mG][mC][mU][mG][mC] | 703 | [MePhosphonate-4O-mUs][fAs][fAs][fG][fU][mU][fG][mG][mU][fG][mU][mC][mA][fA][mU][mU][mA][mA][mG][mCs][mGs][mG] | 704 |
| 157 | [mCs][mU][mU][mA][mA][mU][mU][fG][fA][fC][fA][mC][mC][mA][mA][mC][mU][mU][mU][mA][mG][mC][mA][mG][mC][mC][mG][ademA-GalNAc][ademA-GalNAc][ademA-GalNAc][mG][mG][mC][mU][mG][mC] | 705 | [MePhosphonate-4O-mUs][fAs][fAs][fA][fG][mU][fU][mG][mG][fU][mG][mU][mC][fA][mA][mU][mU][mA][mA][mGs][mGs][mG] | 706 |
| 158 | [mUs][mU][mA][mA][mU][mU][mG][fA][fC][fA][fC][mC][mA][mA][mC][mU][mU][mU][mU][mA][mG][mC][mA][mG][mC][mC][mG][ademA-GalNAc][ademA-GalNAc][ademA-GalNAc][mG][mG][mC][mU][mG][mC] | 707 | [MePhosphonate-4O-mUs][fAs][fAs][fA][fA][mG][fU][mU][mG][fG][mU][mG][mU][fC][mA][mA][mU][mU][mA][mAs][mGs][mG] | 708 |
| 159 | [mUs][mA][mA][mU][mU][mG][mA][fC][fA][fC][fC][mA][mA][mC][mU][mU][mU][mU][mC][mA][mG][mC][mA][mG][mC][mC][mG][ademA-GalNAc][ademA-GalNAc][ademA-GalNAc][mG][mG][mC][mU][mG][mC] | 709 | [MePhosphonate-4O-mUs][fGs][fAs][fA][fA][mA][fG][mU][mU][fG][mG][mU][mG][fU][mC][mA][mA][mU][mU][mAs][mGs][mG] | 710 |
| 160 | [mAs][mU][mU][mG][mA][mA][mG][fG][fG][fG][fU][mG][mC][mU][mG][mU][mG][mC][mU][mA][mG][mC][mA][mG][mC][mC][mG][ademA-GalNAc][ademA-GalNAc][ademA-GalNAc][mG][mG][mC][mU][mG][mC] | 711 | [MePhosphonate-4O-mUs][fAs][fGs][fC][fA][mC][fA][mG][mC][fA][mC][mC][mC][fC][mU][mU][mC][mA][mA][mUs][mGs][mG] | 712 |
| 161 | [mCs][mU][mU][mG][mG][mA][mC][fA][fA][fA][fA][mG][mG][mA][mU][mU][mG][mU][mG][mA][mG][mC][mA][mG][mC][mC][mG][ademA-GalNAc][ademA-GalNAc][ademA-GalNAc][mG][mG][mC][mU][mG][mC] | 713 | [MePhosphonate-4O-mUs][fCs][fAs][fC][fA][mA][fU][mC][mC][fU][mU][mU][mU][fG][mU][mC][mC][mA][mA][mGs][mGs][mG] | 714 |
| 162 | [mUs][mU][mG][mG][mA][mC][mA][fA][fA][fA][fG][mG][mA][mU][mU][mG][mU][mG][mG][mA][mG][mC][mA][mG][mC][mC][mG][ademA-GalNAc][ademA-GalNAc][ademA-GalNAc][mG][mG][mC][mU][mG][mC] | 715 | [MePhosphonate-4O-mUs][fCs][fCs][fA][fC][mA][fA][mU][mC][fC][mU][mU][mU][fU][mG][mU][mC][mC][mA][mAs][mGs][mG] | 716 |
| 163 | [mUs][mC][mA][mA][mC][mG][mG][fU][fU][fC][fC][mC][mU][mU][mG][mA][mU][mU][mU][mA][mG][mC][mA][mG] | 717 | [MePhosphonate-4O-mUs][fAs][fAs][fA][fU][mC][fA][mA][mG][fG][mG][mA][mA][fC][mC][mG][mU][mU][mG][mAs][mGs][mG] | 718 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mC][mG][ademA-GalNAc] [ademA-GalNAc][ademA-GalNAc][mG] [mG][mC][mU][mG][mC] | | | |
| 164 | [mCs][mA][mA][mC] [mG][mG][mU][fU][fC] [fC][fC][mU][mU][mG] [mA][mU][mU][mU][mC] [mA][mG][mC][mA][mG] [mC][mC][mG][ademA-GalNAc] [ademA-GalNAc][ademA-GalNAc][mG] [mG][mC][mU][mG][mC] | 719 | [MePhosphonate-4O-mUs][fGs][fAs][fA][fA][mU] [fC][mA][mA][fG][mG][mG] [mA][fA][mC][mC][mG][mU] [mU][mGs][mGs][mG] | 720 |
| 165 | [mAs][mA][mC][mG] [mG][mU][mU][fC][fC] [fC][fU][mU][mG][mA] [mU][mU][mU][mC][mU] [mA][mG][mC][mA][mG] [mC][mC][mG][ademA-GalNAc] [ademA-GalNAc][ademA-GalNAc][mG] [mG][mC][mU][mG][mC] | 721 | [MePhosphonate-4O-mUs][fAs][fGs][fA][fA][mA] [fU][mC][mA][fA][mG][mG] [mG][fA][mA][mC][mC][mG] [mU][mUs][mGs][mG] | 722 |
| 166 | [mAs][mC][mG][mG] [mU][mU][mC][fC][fC] [fU][fU][mG][mA][mU] [mU][mU][mC][mU][mU] [mA][mG][mC][mA][mG] [mC][mC][mG][ademA-GalNAc] [ademA-GalNAc][ademA-GalNAc][mG] [mG][mC][mU][mG][mC] | 723 | [MePhosphonate-4O-mUs][fAs][fAs][fG][fA][mA] [fA][mU][mC][fA][mA][mG] [mG][fG][mA][mA][mC][mC] [mG][mUs][mGs][mG] | 724 |
| 167 | [mGs][mU][mA][mC] [mA][mU][mU][fG][fA] [fC][fC][mA][mG][mA] [mC][mC][mA][mU][mG] [mA][mG][mC][mA][mG] [mC][mC][mG][ademA-GalNAc] [ademA-GalNAc][ademA-GalNAc][mG] [mG][mC][mU][mG][mC] | 725 | [MePhosphonate-4O-mUs][fCs][fAs][fU][fG][mG] [fU][mC][mU][fG][mG][mU] [mC][fA][mA][mU][mG][mU] [mA][mCs][mGs][mG] | 726 |
| 168 | [mAs][mC][mC][mU] [mG][mU][mA][fC][fC] [fA][fC][mC][mU][mC] [mC][mU][mG][mU][mG] [mA][mG][mC][mA][mG] [mC][mC][mG][ademA-GalNAc] [ademA-GalNAc][ademA-GalNAc][mG] [mG][mC][mU][mG][mC] | 727 | [MePhosphonate-4O-mUs][fCs][fAs][fC][fA][mG] [fG][mA][mG][fG][mU][mG] [mG][fU][mA][mC][mA][mG] [mG][mUs][mGs][mG] | 728 |
| 169 | [mCs][mC][mU][mG] [mU][mA][mC][fC][fA] [fC][fC][mU][mC][mC] [mU][mG][mU][mG][mU] [mA][mG][mC][mA][mG] [mC][mC][mG][ademA-GalNAc] [ademA-GalNAc][ademA-GalNAc][mG] [mG][mC][mU][mG][mC] | 729 | [MePhosphonate-4O-mUs][fAs][fCs][fA][fC][mA] [fG][mG][mA][fG][mG][mU] [mG][fG][mU][mA][mC][mA] [mG][mGs][mGs][mG] | 730 |
| 170 | [mGs][mU][mA][mC] [mC][mA][mC][fC][fU] [fC][fC][mU][mG][mU] [mG][mU][mC][mA][mU] [mA][mG][mC][mA][mG] [mC][mC][mG][ademA-GalNAc] [ademA-GalNAc][ademA-GalNAc][mG] [mG][mC][mU][mG][mC] | 731 | [MePhosphonate-4O-mUs][fAs][fUs][fG][fA][mC] [fA][mC][mA][fG][mG][mA] [mG][fG][mU][mG][mG][mU] [mA][mCs][mGs][mG] | 732 |
| 171 | [mGs][mC][mA][mC] [mA][mG][mG][fC][fA] [fU][fC][mA][mA][mG] [mU][mU][mC][mU][mA] [mA][mG][mC][mA][mG] [mC][mC][mG][ademA-GalNAc] [ademA-GalNAc][ademA-GalNAc][mG] [mG][mC][mU][mG][mC] | 733 | [MePhosphonate-4O-mUs][fUs][fAs][fG][fA][mA] [fC][mU][mU][fG][mA][mU] [mG][fC][mC][mU][mG][mU] [mG][mCs][mGs][mG] | 734 |
| 172 | [mAs][mC][mA][mG] [mG][mC][mA][fU][fC] [fA][fA][mG][mU][mU] | 735 | [MePhosphonate-4O-mUs][fAs][fGs][fU][fA][mG] [fA][mA][mC][fU][mU][mG] | 736 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mC][mU][mA][mC][mU][mA][mG][mC][mA][mG][mC][mC][mG][ademA-GalNAc][ademA-GalNAc][ademA-GalNAc][mG][mG][mC][mU][mG][mC] | | [mA][fU][mG][mC][mC][mU][mG][mUs][mGs][mG] | |
| 173 | [mCs][mA][mG][mG][mC][mA][mU][fC][fA][fA][fG][mU][mU][mC][mU][mA][mC][mU][mC][mA][mG][mC][mA][mG][mC][mC][mG][ademA-GalNAc][ademA-GalNAc][ademA-GalNAc][mG][mG][mC][mU][mG][mC] | 737 | [MePhosphonate-4O-mUs][fGs][fAs][fG][fU][mA][fG][mA][mA][fC][mU][mU][mG][fA][mU][mG][mC][mC][mU][mGs][mGs][mG] | 738 |
| 174 | [mAs][mG][mG][mC][mA][mU][mC][fA][fA][fG][fU][mU][mC][mU][mA][mC][mU][mC][mC][mA][mG][mC][mA][mG][mC][mC][mG][ademA-GalNAc][ademA-GalNAc][ademA-GalNAc][mG][mG][mC][mU][mG][mC] | 739 | [MePhosphonate-4O-mUs][fGs][fGs][fA][fG][mU][fA][mG][mA][fA][mC][mU][mU][fG][mA][mU][mG][mC][mC][mUs][mGs][mG] | 740 |
| 175 | [mGs][mG][mC][mA][mU][mC][mA][fA][fG][fU][fU][mC][mU][mA][mC][mU][mC][mC][mA][mA][mG][mC][mA][mG][mC][mC][mG][ademA-GalNAc][ademA-GalNAc][ademA-GalNAc][mG][mG][mC][mU][mG][mC] | 741 | [MePhosphonate-4O-mUs][fUs][fGs][fG][fA][mG][fU][mA][mG][fA][mA][mC][mU][fU][mG][mA][mU][mG][mC][mCs][mGs][mG] | 742 |
| 176 | [mGs][mC][mA][mU][mC][mA][mA][fG][fU][fU][fC][mU][mA][mC][mU][mC][mC][mA][mU][mA][mG][mC][mA][mG][mC][mC][mG][ademA-GalNAc][ademA-GalNAc][ademA-GalNAc][mG][mG][mC][mU][mG][mC] | 743 | [MePhosphonate-4O-mUs][fAs][fUs][fG][fG][mA][fG][mU][mA][fG][mA][mA][mC][fU][mU][mG][mA][mU][mG][mCs][mGs][mG] | 744 |
| 177 | [mCs][mA][mU][mC][mA][mA][mG][fU][fU][fC][fU][mA][mC][mU][mC][mC][mA][mU][mU][mA][mG][mC][mA][mG][mC][mC][mG][ademA-GalNAc][ademA-GalNAc][ademA-GalNAc][mG][mG][mC][mU][mG][mC] | 745 | [MePhosphonate-4O-mUs][fAs][fAs][fU][fG][mG][fA][mG][mU][fA][mG][mA][mA][fC][mU][mU][mG][mA][mU][mGs][mGs][mG] | 746 |
| 178 | [mAs][mU][mC][mA][mA][mG][mU][fU][fC][fU][fA][mC][mU][mC][mC][mA][mU][mU][mC][mA][mG][mC][mA][mG][mC][mC][mG][ademA-GalNAc][ademA-GalNAc][ademA-GalNAc][mG][mG][mC][mU][mG][mC] | 747 | [MePhosphonate-4O-mUs][fGs][fAs][fA][fU][mG][fG][mA][mG][fU][mA][mG][mA][fA][mC][mU][mU][mG][mA][mUs][mGs][mG] | 748 |
| 179 | [mUs][mC][mA][mA][mG][mU][mU][fC][fU][fA][fC][mU][mC][mC][mA][mU][mU][mC][mA][mA][mG][mC][mA][mG][mC][mC][mG][ademA-GalNAc][ademA-GalNAc][ademA-GalNAc][mG][mG][mC][mU][mG][mC] | 749 | [MePhosphonate-4O-mUs][fUs][fGs][fA][fA][mU][fG][mG][mA][fG][mU][mA][mG][fA][mA][mC][mU][mU][mG][mAs][mGs][mG] | 750 |
| 180 | [mCs][mA][mA][mG][mU][mU][mC][fU][fA][fC][fU][mC][mC][mA][mU][mU][mC][mA][mG][mA][mG][mC][mA][mG][mC][mC][mG][ademA-GalNAc][ademA-GalNAc][ademA-GalNAc][mG][mG][mC][mU][mG][mC] | 751 | [MePhosphonate-4O-mUs][fCs][fUs][fG][fA][mA][fU][mG][mG][fA][mG][mU][mA][fG][mA][mA][mC][mU][mU][mGs][mGs][mG] | 752 |
| 181 | [mAs][mA][mG][mU][mU][mC][mU][fA][fC][fU][fC][mC][mA][mU][mU][mC][mA][mG][mC][mA][mG][mC][mA][mG] | 753 | [MePhosphonate-4O-mUs][fGs][fCs][fU][fG][mA][fA][mU][mG][fG][mA][mG][mU][fA][mG][mA][mA][mC][mU][mUs][mGs][mG] | 754 |

TABLE 4-continued

| GalXC ™-SCAP Oligonucleotides (modified). | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| | [mC][mC][mG][ademA-GalNAc][ademA-GalNAc][ademA-GalNAc][mG][mG][mC][mU][mG][mC] | | | |
| 182 | [mAs][mG][mU][mU][mC][mU][mA][fC][fU][fC][fC][mA][mU][mU][mC][mA][mG][mC][mA][mA][mG][mC][mA][mG][mC][mC][mG][ademA-GalNAc][ademA-GalNAc][ademA-GalNAc][mG][mG][mC][mU][mG][mC] | 755 | [MePhosphonate-4O-mUs][fUs][fGs][fC][fU][mG][fA][mA][mU][fG][mG][mA][mG][fU][mA][mG][mA][mA][mC][mUs][mGs][mG] | 756 |
| 183 | [mGs][mU][mU][mC][mU][mA][mC][fU][fC][fC][fA][mU][mU][mC][mA][mG][mC][mA][mG][mA][mG][mC][mA][mG][mC][mC][mG][ademA-GalNAc][ademA-GalNAc][ademA-GalNAc][mG][mG][mC][mU][mG][mC] | 757 | [MePhosphonate-4O-mUs][fCs][fUs][fG][fC][mU][fG][mA][mA][fU][mG][mG][mA][fG][mU][mA][mG][mA][mA][mCs][mGs][mG] | 758 |
| 184 | [mGs][mU][mG][mU][mC][mA][mU][fC][fU][fC][fA][mG][mA][mC][mA][mA][mC][mC][mU][mA][mG][mC][mA][mG][mC][mC][mG][ademA-GalNAc][ademA-GalNAc][ademA-GalNAc][mG][mG][mC][mU][mG][mC] | 759 | [MePhosphonate-4O-mUs][fAs][fGs][fG][fU][mU][fG][mU][mC][fU][mG][mA][mG][fA][mU][mG][mA][mC][mA][mCs][mGs][mG] | 760 |
| 185 | [mCs][mA][mU][mC][mU][mC][mA][fG][fA][fC][fA][mA][mC][mC][mU][mG][mC][mU][mG][mA][mG][mC][mA][mG][mC][mC][mG][ademA-GalNAc][ademA-GalNAc][ademA-GalNAc][mG][mG][mC][mU][mG][mC] | 761 | [MePhosphonate-4O-mUs][fCs][fAs][fG][fC][mA][fG][mG][mU][fU][mG][mU][mC][fU][mG][mA][mG][mA][mU][mGs][mGs][mG] | 762 |
| 186 | [mUs][mC][mA][mG][mA][mC][mA][fA][fC][fC][fU][mG][mC][mU][mG][mG][mU][mG][mA][mA][mG][mC][mA][mG][mC][mC][mG][ademA-GalNAc][ademA-GalNAc][ademA-GalNAc][mG][mG][mC][mU][mG][mC] | 763 | [MePhosphonate-4O-mUs][fUs][fCs][fA][fC][mC][fA][mG][mC][fA][mG][mG][mU][fU][mG][mU][mC][mU][mG][mAs][mGs][mG] | 764 |
| 187 | [mCs][mG][mG][mG][mG][mA][mC][fC][fU][fG][fU][mU][mA][mC][mA][mG][mA][mC][mA][mA][mG][mC][mA][mG][mC][mC][mG][ademA-GalNAc][ademA-GalNAc][ademA-GalNAc][mG][mG][mC][mU][mG][mC] | 765 | [MePhosphonate-4O-mUs][fUs][fGs][fU][fC][mU][fG][mU][mA][fA][mC][mA][mG][fG][mU][mC][mC][mC][mC][mGs][mGs][mG] | 766 |
| 188 | [mGs][mA][mC][mA][mA][mC][mG][fC][fU][fG][fC][mC][mA][mU][mU][mG][mU][mC][mU][mA][mG][mC][mA][mG][mC][mC][mG][ademA-GalNAc][ademA-GalNAc][ademA-GalNAc][mG][mG][mC][mU][mG][mC] | 767 | [MePhosphonate-4O-mUs][fAs][fGs][fA][fC][mA][fA][mU][mG][fG][mC][mA][mG][fC][mG][mU][mU][mG][mU][mCs][mGs][mG] | 768 |
| 189 | [mGs][mC][mU][mG][mC][mC][mU][fC][fC][fU][fG][mA][mC][mU][mG][mU][mA][mA][mU][mA][mG][mC][mA][mG][mC][mC][mG][ademA-GalNAc][ademA-GalNAc][ademA-GalNAc][mG][mG][mC][mU][mG][mC] | 769 | [MePhosphonate-4O-mUs][fAs][fUs][fU][fA][mC][fA][mG][mU][fC][mA][mG][mG][fA][mG][mG][mC][mA][mG][mCs][mGs][mG] | 770 |
| 190 | [mCs][mU][mG][mC][mC][mU][mC][fC][fU][fG][fA][mC][mU][mG] | 771 | [MePhosphonate-4O-mUs][fUs][fAs][fU][fU][mA][fC][mA][mG][fU][mC][mA] | 772 |

TABLE 4-continued

GalXC ™-SCAP Oligonucleotides (modified).

| GalXC-SCAP Oligo | Sense Strand (passenger; 36-mer) | SEQ ID NO: | Antisense Strand (guide; 22-mer) | SEQ ID NO: |
|---|---|---|---|---|
| | [mU][mA][mA][mU][mA][mA][mG][mC][mA][mG][mC][mC][mG][ademA-GalNAc][ademA-GalNAc][ademA-GalNAc][mG][mG][mC][mU][mG][mC] | | [mG][fG][mA][mG][mG][mC][mA][mGs][mGs][mG] | |
| 191 | [mUs][mA][mA][mU][mA][mU][mU][fA][fA][fA][fC][mU][mU][mU][mU][mU][mU][mA][mA][mA][mG][mC][mA][mG][mC][mC][mG][ademA-GalNAc][ademA-GalNAc][ademA-GalNAc][mG][mG][mC][mU][mG][mC] | 773 | [MePhosphonate-4O-mUs][fUs][fUs][fA][fA][mA][fA][mA][mA][fG][mU][mU][mU][fA][mA][mU][mA][mU][mU][mAs][mGs][mG] | 774 |
| 192 | [mAs][mA][mU][mA][mU][mU][mA][fA][fA][fC][fU][mU][mU][mU][mU][mU][mA][mA][mA][mA][mG][mC][mA][mG][mC][mC][mG][ademA-GalNAc][ademA-GalNAc][ademA-GalNAc][mG][mG][mC][mU][mG][mC] | 775 | [MePhosphonate-4O-mUs][fUs][fUs][fU][fA][mA][fA][mA][mA][fA][mG][mU][mU][fU][mA][mA][mU][mA][mU][mUs][mGs][mG] | 776 |

The human hepatocyte 3D spheroid-based assay described in Example 2 is repeated with the GalXC™-SCAP oligonucleotides of Table 4, the results of which are shown in Table 5.

TABLE 5

GalXC ™-SCAP Oligonucleotide SCAP mRNA Knockdown in 3D Human Spheroids; administered at 100 nM for 7 Days; -5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| GalXC ™-SCAP | % mRNA Remaining | % SEM | % mRNA Remaining | % SEM | % mRNA Remaining | % SEM |
| 1 | 67.3 | 11.5 | 66.3 | 12.0 | 66.8 | 0.7 |
| 2 | 26.3 | 12.1 | 17.7 | 7.8 | 22.0 | 6.1 |
| 3 | 43.5 | 4.7 | 48.0 | 5.6 | 45.7 | 3.2 |
| 4 | 64.2 | 12.4 | 55.8 | 13.6 | 60.0 | 6.0 |
| 5 | 73.5 | 10.2 | 86.3 | 11.0 | 79.9 | 9.0 |
| 6 | 59.8 | 10.1 | 94.1 | 11.3 | 77.0 | 24.3 |
| 7 | 43.9 | 7.8 | 60.8 | 11.1 | 52.3 | 11.9 |
| 8 | 94.4 | 26.7 | 110.7 | 19.3 | 102.6 | 11.5 |
| 9 | 32.7 | 5.0 | 53.7 | 10.3 | 43.2 | 14.8 |
| 10 | 44.1 | 3.3 | 61.7 | 5.1 | 52.9 | 12.4 |
| 11 | 77.1 | 21.9 | 97.5 | 18.5 | 87.3 | 14.4 |
| 12 | 64.3 | 54.4 | 72.5 | 53.6 | 68.4 | 5.8 |
| 13 | 6.4 | 1.9 | 36.3 | 6.9 | 21.4 | 21.1 |
| 14 | 80.4 | 16.1 | 104.2 | 17.8 | 92.3 | 16.8 |
| 15 | 87.1 | 10.4 | 111.2 | 12.5 | 99.2 | 17.0 |
| 16 | 91.3 | 19.6 | 106.5 | 23.2 | 98.9 | 10.8 |
| 17 | 64.3 | 6.3 | 101.3 | 14.1 | 82.8 | 26.2 |
| 18 | 99.0 | 18.7 | 101.6 | 28.4 | 100.3 | 1.8 |
| 19 | 75.7 | 11.1 | 90.1 | 16.0 | 82.9 | 10.2 |
| 20 | 35.2 | 7.4 | 45.6 | 12.1 | 40.4 | 7.3 |
| 21 | 32.7 | 7.0 | 35.0 | 11.0 | 33.9 | 1.6 |
| 22 | 49.3 | 4.8 | 61.6 | 5.2 | 55.4 | 8.7 |
| 23 | 76.2 | 16.4 | 86.0 | 20.5 | 81.1 | 6.9 |
| 24 | 22.7 | 4.6 | 38.0 | 7.1 | 30.4 | 10.8 |
| 25 | 110.6 | 19.0 | 103.6 | 19.7 | 107.1 | 4.9 |
| 26 | 57.2 | 16.0 | 67.9 | 16.1 | 62.6 | 7.6 |
| 27 | 66.4 | 11.2 | 78.6 | 11.9 | 72.5 | 8.6 |
| 28 | 100.0 | 22.1 | 134.8 | 21.6 | 117.4 | 24.6 |
| 29 | 53.2 | 13.3 | 58.1 | 13.8 | 55.6 | 3.5 |
| 30 | 42.7 | 10.6 | 66.5 | 15.3 | 54.6 | 16.8 |
| 31 | 46.2 | 5.8 | 89.9 | 12.6 | 68.0 | 31.0 |

TABLE 5-continued

GalXC ™-SCAP Oligonucleotide SCAP mRNA Knockdown in 3D Human Spheroids; administered at 100 nM for 7 Days; -5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| GalXC ™-SCAP | % mRNA Remaining | % SEM | % mRNA Remaining | % SEM | % mRNA Remaining | % SEM |
| 32 | 59.9 | 12.1 | 73.3 | 11.8 | 66.6 | 9.5 |
| 33 | 29.4 | 5.5 | 38.5 | 7.4 | 33.9 | 6.4 |
| 34 | 92.3 | 19.3 | 127.0 | 18.3 | 109.7 | 24.6 |
| 35 | 95.5 | 25.6 | 120.3 | 27.5 | 107.9 | 17.5 |
| 36 | 69.9 | 20.9 | 102.1 | 33.2 | 86.0 | 22.8 |
| 37 | 57.1 | 20.6 | 82.3 | 22.0 | 69.7 | 17.8 |
| 38 | 53.7 | 12.9 | 70.4 | 14.8 | 62.1 | 11.8 |
| 39 | 87.5 | 19.1 | 107.1 | 26.1 | 97.3 | 13.8 |
| 40 | 67.7 | 16.2 | 93.7 | 26.9 | 80.7 | 18.4 |
| 41 | 78.5 | 16.1 | 94.7 | 14.0 | 86.6 | 11.5 |
| 42 | 43.0 | 5.8 | 39.2 | 5.7 | 41.1 | 2.7 |
| 43 | 25.8 | 4.7 | 29.7 | 5.4 | 27.7 | 2.8 |
| 44 | 55.4 | 7.6 | 72.2 | 8.6 | 63.8 | 11.9 |
| 45 | 78.0 | 7.7 | 101.9 | 7.2 | 89.9 | 16.9 |
| 46 | 53.4 | 38.0 | 118.6 | 56.2 | 86.0 | 46.1 |
| 47 | 69.1 | 10.8 | 87.4 | 13.8 | 78.2 | 12.9 |
| 48 | 155.7 | 107.9 | 73.6 | 57.4 | 114.7 | 58.0 |
| 49 | 57.1 | 9.2 | 62.7 | 11.9 | 59.9 | 3.9 |
| 50 | 61.2 | 6.3 | 76.6 | 7.7 | 68.9 | 10.9 |
| 51 | 37.8 | 6.3 | 38.1 | 7.6 | 38.0 | 0.2 |
| 52 | 32.6 | 5.7 | 35.9 | 8.4 | 34.2 | 2.3 |
| 53 | 50.4 | 3.8 | 60.5 | 6.5 | 55.4 | 7.1 |
| 54 | 41.8 | 9.4 | 51.4 | 12.0 | 46.6 | 6.8 |
| 55 | 58.5 | 8.0 | 57.5 | 11.4 | 58.0 | 0.7 |
| 56 | 82.7 | 14.0 | 86.3 | 17.9 | 84.5 | 2.5 |
| 57 | 59.9 | 5.9 | 64.3 | 5.5 | 62.1 | 3.1 |
| 58 | 90.3 | 11.2 | 87.7 | 10.9 | 89.0 | 1.9 |
| 59 | 78.7 | 8.1 | 83.8 | 7.3 | 81.3 | 3.6 |
| 60 | 40.2 | 8.8 | 35.7 | 8.0 | 37.9 | 3.2 |
| 61 | 46.5 | 8.6 | 49.6 | 8.7 | 48.1 | 2.2 |
| 62 | 33.4 | 6.5 | 38.3 | 7.2 | 35.9 | 3.5 |
| 63 | 30.7 | 5.0 | 41.2 | 6.5 | 36.0 | 7.4 |
| 64 | 60.0 | 11.9 | 48.1 | 9.6 | 54.1 | 8.4 |
| 65 | 39.0 | 5.5 | 39.0 | 6.1 | 39.0 | 0.1 |
| 66 | 30.3 | 3.4 | 25.6 | 3.6 | 28.0 | 3.3 |
| 67 | 14.2 | 3.6 | 17.0 | 3.7 | 15.6 | 1.9 |
| 68 | 33.4 | 5.2 | 28.6 | 5.2 | 31.0 | 3.4 |

TABLE 5-continued

GalXC ™-SCAP Oligonucleotide SCAP mRNA Knockdown in 3D Human Spheroids; administered at 100 nM for 7 Days; -5' and -3' Assays % mRNA Remaining (normalized to Hs HPRT-517 (HEX) and Hs SFRS9-569 (HEX) vs mock control).

| | HPRT-517 (HEX) | | SFRS9-569 (HEX) | | Average | |
|---|---|---|---|---|---|---|
| GalXC ™-SCAP | % mRNA Remaining | % SEM | % mRNA Remaining | % SEM | % mRNA Remaining | % SEM |
| 69 | 27.9 | 1.9 | 32.7 | 4.3 | 30.3 | 3.4 |
| 70 | 11.0 | 1.2 | 12.4 | 1.7 | 11.7 | 1.0 |
| 71 | 74.5 | 6.9 | 87.7 | 7.5 | 81.1 | 9.3 |
| 72 | 88.7 | 7.1 | 83.0 | 7.8 | 85.8 | 4.1 |
| 73 | 41.3 | 12.4 | 46.3 | 5.4 | 43.8 | 3.5 |
| 74 | 77.9 | 28.7 | 99.8 | 29.7 | 88.9 | 15.4 |
| 75 | 45.8 | 20.7 | 86.2 | 21.2 | 66.0 | 28.6 |
| 76 | 81.9 | 13.4 | 86.9 | 15.8 | 84.4 | 3.5 |
| 77 | 94.3 | 14.9 | 105.8 | 13.8 | 100.0 | 8.2 |
| 78 | 73.6 | 10.1 | 84.8 | 12.6 | 79.2 | 7.9 |
| 79 | 41.2 | 8.6 | 47.3 | 9.2 | 44.2 | 4.3 |
| 80 | 68.6 | 6.7 | 91.5 | 8.5 | 80.0 | 16.2 |
| 81 | 60.5 | 5.8 | 67.7 | 10.2 | 64.1 | 5.1 |
| 82 | 49.4 | 21.3 | 49.5 | 12.3 | 49.5 | 0.1 |
| 83 | 65.4 | 7.3 | 85.3 | 10.4 | 75.4 | 14.1 |
| 84 | 66.2 | 10.2 | 60.9 | 11.2 | 63.5 | 3.8 |
| 85 | 67.7 | 4.9 | 78.3 | 6.6 | 73.0 | 7.5 |
| 86 | 58.2 | 7.3 | 71.3 | 9.5 | 64.7 | 9.3 |
| 87 | 66.2 | 4.9 | 79.2 | 8.8 | 72.7 | 9.2 |
| 88 | 82.1 | 11.0 | 94.1 | 15.9 | 88.1 | 8.5 |
| 89 | 83.4 | 56.0 | 48.4 | 20.8 | 65.9 | 24.8 |
| 90 | 67.7 | 9.7 | 67.3 | 9.1 | 67.5 | 0.3 |
| 91 | 56.9 | 23.8 | 55.5 | 22.0 | 56.2 | 1.0 |
| 92 | 83.5 | 8.7 | 84.2 | 9.2 | 83.9 | 0.4 |
| 93 | 49.2 | 4.3 | 45.6 | 5.4 | 47.4 | 2.5 |
| 94 | 62.6 | 6.2 | 79.6 | 9.5 | 71.1 | 12.1 |
| 95 | 43.8 | 9.1 | 48.4 | 10.3 | 46.1 | 3.2 |
| 96 | 47.6 | 6.8 | 48.7 | 6.1 | 48.1 | 0.7 |
| 97 | 127.0 | 110.9 | 66.2 | 54.3 | 96.6 | 43.0 |
| 98 | 56.9 | 5.5 | 68.5 | 5.4 | 62.7 | 8.2 |
| 99 | 83.0 | 6.1 | 84.6 | 9.6 | 83.8 | 1.1 |
| 100 | 72.1 | 25.4 | 137.4 | 41.3 | 104.7 | 46.2 |
| 101 | 39.0 | 6.9 | 48.5 | 9.0 | 43.8 | 6.7 |
| 102 | 55.8 | 6.4 | 74.0 | 10.7 | 64.9 | 12.9 |
| 103 | 21.6 | 10.5 | 41.7 | 15.9 | 31.6 | 14.2 |
| 104 | 12.6 | 7.3 | 15.9 | 11.4 | 14.2 | 2.3 |
| 105 | 17.6 | 3.1 | 60.0 | 6.8 | 38.8 | 30.0 |
| 106 | 3.3 | 0.6 | 13.9 | 5.1 | 8.6 | 7.5 |
| 107 | 6.4 | 1.5 | 22.9 | 5.2 | 14.7 | 11.7 |
| 108 | 17.7 | 2.9 | 44.6 | 8.3 | 31.1 | 19.1 |
| 109 | 15.8 | 10.0 | 57.0 | 30.9 | 36.4 | 29.2 |
| 110 | 12.1 | 1.4 | 49.2 | 5.2 | 30.6 | 26.2 |
| 111 | 27.8 | 6.9 | 50.5 | 12.1 | 39.2 | 16.1 |
| 112 | 28.8 | 15.5 | 64.5 | 27.3 | 46.7 | 25.2 |
| 113 | 20.7 | 3.0 | 40.6 | 5.4 | 30.6 | 14.1 |
| 114 | 37.7 | 17.1 | 71.2 | 22.6 | 54.4 | 23.7 |
| 115 | 17.5 | 6.2 | 30.2 | 11.8 | 23.9 | 9.0 |
| 116 | 63.9 | 9.2 | 86.9 | 11.8 | 75.4 | 16.3 |
| 117 | 30.5 | 2.9 | 39.4 | 4.1 | 34.9 | 6.3 |
| 118 | 43.9 | 10.9 | 61.8 | 14.2 | 52.9 | 12.7 |
| 119 | 44.0 | 5.2 | 57.4 | 8.7 | 50.7 | 9.5 |
| 120 | 38.1 | 12.1 | 55.8 | 15.3 | 46.9 | 12.5 |
| 121 | 59.4 | 29.3 | 86.1 | 35.7 | 72.8 | 18.9 |
| 122 | 62.6 | 12.2 | 81.9 | 13.3 | 72.3 | 13.7 |
| 123 | 55.7 | 19.8 | 85.2 | 30.5 | 70.5 | 20.8 |
| 124 | 35.2 | 8.0 | 80.9 | 21.6 | 58.1 | 32.4 |
| 125 | 57.3 | 8.2 | 71.1 | 7.1 | 64.2 | 9.7 |
| 126 | 86.3 | 21.0 | 88.9 | 25.2 | 87.6 | 1.8 |
| 127 | 83.4 | 15.4 | 106.5 | 22.9 | 94.9 | 16.3 |
| 128 | 119.6 | 61.8 | 78.2 | 59.0 | 98.9 | 29.3 |
| 129 | 88.0 | 14.9 | 94.3 | 16.8 | 91.2 | 4.4 |
| 130 | 94.3 | 68.0 | 83.8 | 54.1 | 89.1 | 7.5 |
| 131 | 50.2 | 17.0 | 66.4 | 14.8 | 58.3 | 11.5 |
| 132 | 50.9 | 5.1 | 47.6 | 4.6 | 49.3 | 2.4 |
| 133 | 33.1 | 18.1 | 45.3 | 13.4 | 39.2 | 8.6 |
| 134 | 38.7 | 21.1 | 61.9 | 25.4 | 50.3 | 16.4 |
| 135 | — | — | 52.6 | 31.5 | 52.6 | 32.5 |
| 136 | 34.2 | 10.0 | 37.6 | 10.1 | 35.9 | 2.4 |
| 137 | 92.8 | 24.3 | 92.7 | 21.9 | 92.8 | 0.1 |
| 138 | 49.7 | 14.6 | 48.9 | 11.4 | 49.3 | 0.6 |
| 139 | 74.2 | 11.0 | 86.8 | 11.9 | 80.5 | 8.9 |
| 140 | 91.6 | 25.4 | 92.3 | 27.1 | 91.9 | 0.5 |
| 141 | 61.9 | 7.5 | 64.1 | 8.2 | 63.0 | 1.6 |
| 142 | 60.3 | 10.8 | 72.7 | 17.4 | 66.5 | 8.8 |
| 143 | 136.6 | 56.4 | 55.2 | 41.9 | 95.9 | 57.6 |
| 144 | 121.2 | 42.0 | 59.0 | 29.7 | 90.1 | 44.0 |
| 145 | 83.5 | 10.9 | 87.6 | 12.3 | 85.5 | 2.9 |
| 146 | 73.6 | 7.3 | 67.9 | 4.9 | 70.7 | 4.0 |
| 147 | 104.3 | 16.4 | 77.3 | 8.5 | 90.8 | 19.1 |
| 148 | 84.2 | 12.7 | 81.0 | 10.8 | 82.6 | 2.3 |
| 149 | 53.4 | 9.7 | 58.5 | 11.8 | 55.9 | 3.6 |
| 150 | 77.3 | 25.8 | 69.8 | 23.9 | 73.5 | 5.4 |
| 151 | 108.2 | 43.9 | 120.3 | 39.8 | 114.3 | 8.5 |
| 152 | 66.5 | 12.1 | 56.5 | 11.2 | 61.5 | 7.1 |
| 153 | 43.3 | 6.4 | 57.9 | 11.6 | 50.6 | 10.4 |
| 154 | 78.7 | 8.2 | 78.4 | 9.0 | 78.5 | 0.2 |
| 155 | 86.6 | 8.1 | 69.9 | 7.7 | 78.3 | 11.8 |
| 156 | 36.0 | 4.9 | 40.7 | 4.3 | 38.3 | 3.3 |
| 157 | 39.6 | 3.7 | 31.2 | 3.2 | 35.4 | 5.9 |
| 158 | 25.2 | 11.5 | 26.4 | 11.8 | 25.8 | 0.8 |
| 159 | 24.6 | 7.4 | 22.5 | 6.1 | 23.6 | 1.5 |
| 160 | 101.4 | 17.4 | 86.1 | 16.5 | 93.7 | 10.8 |
| 161 | 90.3 | 12.2 | 65.3 | 16.3 | 77.8 | 17.7 |
| 162 | 74.4 | 11.1 | 66.2 | 12.6 | 70.3 | 5.8 |
| 163 | 19.5 | 2.8 | 10.2 | 2.2 | 14.8 | 6.6 |
| 164 | 23.3 | 2.6 | 18.1 | 3.6 | 20.7 | 3.6 |
| 165 | 16.7 | 7.7 | 10.4 | 4.2 | 13.6 | 4.5 |
| 166 | 27.2 | 4.2 | 23.2 | 2.7 | 25.2 | 2.8 |
| 167 | 87.0 | 10.1 | 77.9 | 8.7 | 82.5 | 6.4 |
| 168 | 116.7 | 39.9 | 89.4 | 27.8 | 103.1 | 19.3 |
| 169 | 100.9 | 7.7 | 87.6 | 5.3 | 94.2 | 9.4 |
| 170 | 95.2 | 22.4 | 83.3 | 18.1 | 89.3 | 8.4 |
| 171 | 47.4 | 10.3 | 42.2 | 9.8 | 44.8 | 3.7 |
| 172 | 63.3 | 14.3 | 43.2 | 10.7 | 53.2 | 14.2 |
| 173 | 55.6 | 10.5 | 48.9 | 8.3 | 52.2 | 4.7 |
| 174 | 45.5 | 6.5 | 38.9 | 7.5 | 42.2 | 4.6 |
| 175 | 45.5 | 15.1 | 33.2 | 13.4 | 39.4 | 8.7 |
| 176 | 30.7 | 7.3 | 30.2 | 6.2 | 30.4 | 0.3 |
| 177 | 46.4 | 7.4 | 45.0 | 5.9 | 45.7 | 1.0 |
| 178 | 38.9 | 4.9 | 41.3 | 5.2 | 40.1 | 1.7 |
| 179 | 63.6 | 12.7 | 49.6 | 14.6 | 56.6 | 9.9 |
| 180 | 80.4 | 9.9 | 72.2 | 8.1 | 76.3 | 5.8 |
| 181 | 68.2 | 7.5 | 50.7 | 7.1 | 59.4 | 12.4 |
| 182 | 37.9 | 22.9 | 53.0 | 24.5 | 45.5 | 10.7 |
| 183 | 93.8 | 20.0 | 89.0 | 17.9 | 91.4 | 3.4 |
| 184 | 95.3 | 21.4 | 132.1 | 24.0 | 113.7 | 26.0 |
| 185 | 77.4 | 5.5 | 79.3 | 9.4 | 78.3 | 1.4 |
| 186 | 55.1 | 3.5 | 39.1 | 4.1 | 47.1 | 11.4 |
| 187 | 69.3 | 37.6 | 78.8 | 30.9 | 74.0 | 6.7 |
| 188 | 81.2 | 15.0 | 66.2 | 14.1 | 73.7 | 10.6 |
| 189 | 57.2 | 15.8 | 58.6 | 12.4 | 57.9 | 1.0 |
| 190 | 69.4 | 29.6 | 70.6 | 28.9 | 70.0 | 0.9 |
| 191 | 77.3 | 8.0 | 62.2 | 7.6 | 69.7 | 10.7 |
| 192 | 79.9 | 42.5 | 67.8 | 28.7 | 73.9 | 8.5 |

In Vivo Function

Example 4: RNAi Oligonucleotide Modulation of SCAP Activity In Vivo—GalXC™-Based Compounds Mouse studies: The GalXC™-SCAP oligonucleotides, as listed in Tables 3 (unmodified) and 4 (modified), are evaluated in hydrodynamic injection (HDI) mouse model. In the HDI studies, mice are engineered to transiently express human SCAP mRNA in hepatocytes. A GalXC™-SCAP oligonucleotide control (GalXC™-SCAP oligonucleotide no. 42; see, SEQ ID NOs: 475 and 476) is used as a benchmark control. Briefly, 6-8-week-old female CD-1 mice are treated SQ with a GalXC-™SCAP oligonucleotide at a dose level of 2 mg/kg. Three days later (72 hr.), the mice are HDI with a DNA plasmid encoding the full human SCAP gene under control of a ubiquitous cytomegalovirus (CMV) promoter sequence. One day after introduction of the plasmid, liver samples are collected. Total RNA derived from these mice are subjected to qRT-PCR analysis for SCAP mRNA, relative to mice treated only with an identical volume of PBS. The values are normalized for transfection efficiency using the NeoR gene included on the plasmid.

As shown in Tables 6 to 8, a number of GalXC™-SCAP oligonucleotides tested inhibited SCAP activity, as determined by a reduced amount of SCAP mRNA in liver samples from oligonucleotide-treated mice relative to mice treated with PBS. The mean % o of remaining SCAP mRNA in liver samples of mice treated with the GaXC™-SCAP oligonucleotide control relative to mice treated with PBS. Tables 6 to 8 show that a number of the GalXC™-SCAP oligonucleotides tested inhibit SCAP activity to a greater extent than the GaIXC™-SCAP oligonucleotide control.

TABLE 6

In Vivo Activity of GalXC ™-SCAP Oligonucleotides in Mice (single-dose, SQ, 2 mg/kg; 96-hr harvest; HDI of hSCAP plasmid in mice).

| GalXC ™-Oligo | Animal | | | | | | |
|---|---|---|---|---|---|---|---|
| SCAP | 1 | 2 | 3 | 4 | 5 | Average | SEM |
| PBS | 70.0 | 125.3 | 145.2 | 59.4 | — | 100.0 | 20.9 |
| 20 | 120.7 | 88.7 | 89.0 | 90.6 | 67.1 | 91.2 | 8.6 |
| 27 | 47.7 | 58.4 | 52.6 | 45.9 | 63.5 | 53.6 | 3.3 |
| 33 | — | 95.8 | — | 71.8 | 72.5 | 80.0 | 7.9 |
| 42 | 67.8 | 70.5 | 50.7 | 79.1 | 26.7 | 58.9 | 9.3 |
| 43 | 62.4 | 46.8 | 50.2 | 72.9 | 90.0 | 64.5 | 7.9 |
| 44 | 50.6 | 108.5 | 40.0 | 42.0 | 79.5 | 64.1 | 13.2 |
| 57 | 54.0 | — | — | 89.2 | 41.1 | 61.4 | 14.4 |
| 65 | 76.6 | 98.3 | 39.1 | 105.1 | 168.8 | 97.6 | 21.2 |
| 66 | 35.7 | 30.8 | 26.1 | 37.5 | 55.1 | 37.0 | 4.9 |
| 70 | — | 12.6 | 30.8 | 11.2 | 5.83* | 18.2 | 6.3 |
| 104 | 53.7 | 45.8 | 73.7 | 54.0 | 48.3 | 55.1 | 4.9 |
| 105 | 23.7 | 101.6 | 50.3 | 62.9 | 100.6 | 67.8 | 15.0 |
| 106 | 59.6 | 29.8 | 28.4 | 53.5 | 30.5 | 40.4 | 6.7 |
| 107 | 30.3 | 12.4 | 43.0 | 13.1 | 22.1 | 24.2 | 5.7 |
| 108 | 35.5 | 71.6 | 46.4 | 54.2 | 48.1 | 51.1 | 5.9 |
| 113 | 50.5 | 55.2 | 85.0 | 38.8 | 42.9 | 54.5 | 8.1 |
| 117 | 58.7 | 82.1 | 63.0 | 46.9 | 51.6 | 60.4 | 6.1 |
| 120 | 54.1 | — | 43.7 | 55.7 | 90.5 | 61.0 | 10.2 |

TABLE 7

In Vivo Activity of GalXC ™-SCAP Oligonucleotides in Mice (single-dose, SQ, 2 mg/kg; 96-hr harvest; HDI of hSCAP plasmid in mice).

| GalXC ™-Oligo | Animal | | | | | | |
|---|---|---|---|---|---|---|---|
| SCAP | 1 | 2 | 3 | 4 | 5 | Average | SEM |
| PBS | 105.9 | 122.9 | 90.2 | 105.6 | 75.4 | 100.0 | 8.0 |
| 2 | 32.8 | 67.0 | 37.1 | 57.0 | 55.7 | 49.9 | 6.5 |
| 13 | 44.4 | 38.9 | 66.1 | 77.2 | 56.4 | 56.6 | 7.0 |
| 67 | 36.9 | — | 32.1 | 41.5 | 43.5 | 38.5 | 2.5 |

TABLE 7-continued

In Vivo Activity of GalXC ™-SCAP Oligonucleotides in Mice (single-dose, SQ, 2 mg/kg; 96-hr harvest; HDI of hSCAP plasmid in mice).

| GalXC ™-Oligo | Animal | | | | | | |
|---|---|---|---|---|---|---|---|
| SCAP | 1 | 2 | 3 | 4 | 5 | Average | SEM |
| 69 | 56.5 | 51.9 | 50.1 | 60.5 | 51.3 | 54.0 | 1.9 |
| 108 | 45.7 | 88.3 | 80.2 | 56.6 | 134.9 | 81.1 | 15.5 |
| 110 | 65.7 | 50.3 | 24.3 | 30.4 | 48.3 | 43.8 | 7.4 |
| 115 | 15.0 | 45.4 | — | 45.3 | 32.7 | 34.6 | 7.2 |
| 133 | 17.0 | 21.9 | 31.6 | 52.8 | 25.6 | 29.8 | 6.2 |
| 144 | 66.5 | 93.9 | 28.0 | 88.0 | 32.1 | 61.7 | 13.7 |
| 157 | 21.4 | 22.9 | 72.8 | 14.1 | 43.3 | 34.9 | 10.6 |
| 159 | 24.6 | 45.3 | 58.0 | 30.4 | 34.9 | 38.6 | 5.9 |
| 163 | 9.0 | 40.3 | 48.8 | 20.8 | 24.0 | 28.6 | 7.1 |
| 164 | 34.7 | 68.5 | 81.0 | 61.8 | 55.0 | 60.2 | 7.7 |
| 165 | 48.5 | 32.3 | 49.2 | 44.6 | 39.2 | 42.8 | 3.2 |
| 166 | 31.8 | 29.4 | 55.4 | 66.0 | 70.0 | 50.5 | 8.5 |
| 176 | 31.3 | 32.1 | 31.6 | 60.5 | 30.9 | 37.3 | 5.8 |
| 177 | 26.7 | 22.8 | 19.7 | 17.9 | 15.3 | 20.5 | 2.0 |

TABLE 8

In Vivo Activity of GalXC ™-SCAP Oligonucleotides in Mice (single-dose, SQ, 2 mg/kg; 96-hr harvest; HDI of hSCAP plasmid in mice).

| GalXC ™-Oligo | Animal | | | | | | |
|---|---|---|---|---|---|---|---|
| SCAP | 1 | 2 | 3 | 4 | 5 | Average | SEM |
| PBS | 121.8 | 102.2 | 82.8 | 57.4 | 135.8 | 100.0 | 13.9 |
| 66 | 45.5 | 33.4 | 36.9 | 55.5 | 38.9 | 42.0 | 3.9 |
| 70 | 20.0 | 27.6 | 42.6 | 24.4 | 45.3 | 32.0 | 5.1 |
| 107 | 26.3 | 12.3 | 18.7 | 10.5 | 18.5 | 17.3 | 2.8 |
| 151 | 132.9 | 67.9 | 83.6 | 98.1 | 126.3 | 101.8 | 12.4 |
| 152 | 61.4 | 70.6 | 100.5 | 76.0 | 66.1 | 74.9 | 6.8 |
| 153 | 89.8 | 68.2 | 54.4 | 128.9 | 69.7 | 82.2 | 13.0 |
| 154 | 117.0 | 114.8 | 124.6 | 39.4 | 167.8 | 112.7 | 20.7 |
| 155 | 109.6 | 128.6 | 61.2 | 120.9 | 62.1 | 96.5 | 14.5 |
| 156 | 66.2 | 46.3 | 58.4 | 86.0 | 81.5 | 67.7 | 7.3 |
| 157 | 41.6 | 39.6 | 34.5 | 54.1 | 36.0 | 41.2 | 3.5 |

The tables above show that the in vivo HDI results are consistent with the in vitro data in the Huh7 cells and 3D human spheroids of Example 3.

Based on the results above, 7 GaIXC™-SCAP oligonucleotides are selected for a dose-response study in the HDI mouse model, the results of which are shown in Table 9.

TABLE 9

Dose-Response of GalXC ™-SCAP Oligonucleotides in Mice (GalXC ™ multiple-dose, 0.3-3.0 mg/kg, 96-hr harvest; HDI of hSCAP plasmid in mice).

| | | Dose | Animal | | | | | | |
|---|---|---|---|---|---|---|---|---|---|
| | | (mg/kg) | 1 | 2 | 3 | 4 | 5 | Avg | SEM |
| | | | Study 1 | | | | | | |
| GalXC ™-SCAP Oligo | PBS | — | 113.3 | 106.6 | 93.6 | 119.7 | 66.8 | 100.0 | 9.4 |
| | | — | 82.1 | 85.1 | 46.0 | 57.5 | 36.7 | 61.5 | 9.6 |
| | | — | 60.6 | 27.9 | 36.1 | 35.4 | — | 53.3 | 14.4 |
| | 70 | 0.3 | 18.8 | 5.3 | 10.0 | 18.3 | 12.4 | 13.0 | 2.6 |
| | | 1.0 | 62.5 | 67.9 | 43.5 | — | — | 58.0 | 7.4 |
| | | 3.0 | 20.4 | 29.4 | 22.4 | 29.9 | 26.9 | 25.8 | 1.9 |
| | 107 | 0.3 | 8.6 | 9.8 | 16.4 | 9.3 | 6.1 | 10.0 | 1.7 |
| | | 1.0 | 106.3 | 101.1 | 121.0 | 70.0 | 61.4 | 92.0 | 11.3 |
| | | 3.0 | 1.1 | 47.7 | 36.2 | 69.0 | 57.7 | 42.3 | 11.7 |
| | 133 | 0.3 | 19.7 | 16.6 | 20.1 | 23.3 | 18.6 | 19.6 | 1.1 |
| | | 1.0 | 75.7 | 39.3 | 44.1 | 79.7 | 71.3 | 62.0 | 8.4 |
| | | 3.0 | 32.7 | 19.6 | 44.6 | 33.4 | 62.2 | 38.5 | 7.1 |
| | 177 | 0.3 | 15.1 | 15.7 | 8.2 | 27.4 | 32.7 | 19.8 | 4.5 |
| | | 1.0 | 113.3 | 106.6 | 93.6 | 119.7 | 66.8 | 100.0 | 9.4 |
| | | 3.0 | 82.1 | 85.1 | 46.0 | 57.5 | 36.7 | 61.5 | 9.6 |
| | | | Study 2 | | | | | | |
| | PBS | — | 60.6 | 83.1 | 141.2 | 40.6 | 174.4 | 100.0 | 25.1 |
| | | — | 65.1 | 36.4 | 70.9 | 100.7 | 81.7 | 71.0 | 10.6 |
| | | — | 46.5 | 40.4 | 33.5 | 18.8 | 59.2 | 39.7 | 6.7 |
| | 66 | 0.3 | 17.8 | 9.0 | 30.6 | 29.2 | 24.3 | 22.2 | 4.0 |
| | | 1.0 | 66.9 | 32.9 | 48.7 | 54.1 | 51.6 | 50.8 | 5.5 |
| | | 3.0 | 21.2 | 78.9 | 42.3 | 65.8 | 40.7 | 49.8 | 10.2 |
| | 157 | 0.3 | 7.4 | 18.7 | 14.9 | 20.2 | 14.6 | 15.2 | 2.2 |
| | | 1.0 | 101.5 | 59.7 | 53.6 | 110.9 | 117.5 | 88.6 | 13.3 |
| | | 3.0 | 21.2 | 27.4 | 39.6 | 45.2 | 48.3 | 36.3 | 5.2 |
| | 163 | 0.3 | 31.1 | 13.7 | 26.3 | 20.2 | 47.2 | 27.7 | 5.7 |
| | | 1.0 | 60.6 | 83.1 | 141.2 | 40.6 | 174.4 | 100.0 | 25.1 |
| | | 3.0 | 65.1 | 36.4 | 70.9 | 100.7 | 81.7 | 71.0 | 10.6 |

The GalXC™-SCAP oligonucleotides show a dose-dependent reduction of human SCAP mRNA expression. The GalXC™-SCAP oligonucleotides have an $ED_{50}$ between 0.4-0.8 mg/kg against exogenously expressed human SCAP mRNA.

Primate (NHP) studies: Based on the mouse results above, 6 GalXC™-SCAP oligonucleotides are selected for evaluation of their ability to inhibit SCAP activity in NHPs (e.g., rhesus macaques; *Macaca mulatta*) for a single-dose (2 or 6 mg/kg), 84-day study. Here, the NHPs are grouped so that their mean body weights (about 5.4 kg) are comparable between the control and experimental groups. Each cohort contains 6 individuals (3 male and 3 female individuals). The GalXC™-SCAP oligonucleotides are administered SQ on Study Day 0. Blood samples are collected at 2 pre-dose time points (i.e., Days −21 and 0) and then weekly after dosing for a liver enzyme panel and lipid profile. Ultrasound-guided core needle liver biopsies are collected on Study Days −21, 28, 56, and 83. At each time point, total RNA derived from the liver biopsy samples is individualed to qRT-PCR analysis to measure SCAP mRNA in oligonucleotide-treated monkeys relative to monkeys treated with a comparable volume of PBS. To normalize the data, the measurements are made relative to the geometric mean of two reference genes, PPIB and 18S rRNA. As shown in Table 10, treating NHPs with the GalXC™-SCAP oligonucleotides inhibits SCAP activity in the liver, as determined by a reduced amount of SCAP mRNA in liver samples from oligonucleotide-treated NHPs relative to NHPs treated with PBS. For all time points evaluated, GalXC™-SCAP oligonucleotides inhibit SCAP activity to a greater extent than the benchmark PBS and time-matched controls.

TABLE 10

SCAP mRNA Knockdown by Select GalXC ™-SCAP Oligonucleotides in NHP Liver (at Day 28 vs. Pre-Dose and Time-Matched PBS).

| | | Dose | Animal | | | | | | | |
|---|---|---|---|---|---|---|---|---|---|---|
| | | (mg/kg) | 1 | 2 | 3 | 4 | 5 | 6 | Avg | SEM |
| GalXC ™-SCAP Oligo | PBS | — | 158.8 | 91.4 | 79.9 | 91.3 | 91.4 | 87.3 | 100.0 | 11.9 |
| | 66 | 6.0 | 41.4 | 63.2 | 38.5 | 67.1 | 39.1 | 55.0 | 50.7 | 5.2 |
| | 70 | 6.0 | 36.6 | 29.7 | 33.6 | 23.9 | 26.2 | 27.4 | 29.6 | 1.9 |
| | 107 | 2.0 | 44.0 | 62.1 | 50.0 | 52.4 | 42.0 | 72.5 | 53.8 | 4.7 |
| | 107 | 6.0 | 43.8 | 50.2 | 56.4 | 27.9 | 37.6 | 12.0 | 38.0 | 6.6 |
| | 157 | 6.0 | 55.7 | 55.0 | 39.5 | 41.9 | 19.3 | 42.0 | 42.2 | 5.4 |
| | 163 | 6.0 | 24.6 | 29.1 | 32.9 | 26.6 | 45.6 | 37.3 | 32.7 | 3.2 |
| | 177 | 6.0 | 42.7 | 49.2 | 33.7 | 38.3 | 23.6 | 50.4 | 39.7 | 4.1 |

TABLE 11

SCAP mRNA Knockdown by Select GalXC ™-SCAP Oligonucleotides in NHP Liver (at Day 56 vs. Pre-Dose and Time-Matched PBS).

| | | Dose | Animal | | | | | | | |
|---|---|---|---|---|---|---|---|---|---|---|
| | | (mg/kg) | 1 | 2 | 3 | 4 | 5 | 6 | Avg | SEM |
| GalXC ™-SCAP Oligo | PBS | — | 186.6 | 67.8 | 97.7 | 89.3 | 62.0 | 96.6 | 100.0 | 18.4 |
| | 66 | 6.0 | 58.6 | 76.4 | 57.2 | 42.2 | 40.8 | 71.0 | 57.7 | 5.9 |
| | 70 | 6.0 | 43.5 | 28.1 | 23.5 | 37.5 | 39.9 | 30.1 | 33.8 | 3.1 |
| | 107 | 2.0 | 40.6 | 69.1 | 48.9 | 74.2 | 39.7 | 77.2 | 58.3 | 7.0 |
| | 107 | 6.0 | 37.4 | 72.7 | 68.1 | 29.9 | 68.3 | 42.8 | 53.2 | 7.6 |
| | 157 | 6.0 | 54.8 | 88.6 | 50.3 | 30.0 | 47.8 | 57.7 | 54.9 | 7.8 |
| | 163 | 6.0 | 36.1 | 42.9 | 36.0 | 29.1 | 74.3 | 36.3 | 42.5 | 6.6 |
| | 177 | 6.0 | 56.7 | 55.5 | 37.4 | 42.5 | 38.9 | 52.1 | 47.2 | 3.5 |

TABLE 12

SCAP mRNA Knockdown by Select GalXC ™-SCAP Oligonucleotides in NHP Liver (at Day 84 vs. Pre-Dose and Time-Matched PBS).

| | | Dose | Animal | | | | | | | |
|---|---|---|---|---|---|---|---|---|---|---|
| | | (mg/kg) | 1 | 2 | 3 | 4 | 5 | 6 | Avg | SEM |
| GalXC ™-SCAP Oligo | PBS | — | 126.5 | 101.8 | 106.6 | 136.9 | 32.2 | 96.1 | 100.0 | 15.0 |
| | 66 | 6.0 | 62.4 | 82.5 | 125.0 | 79.5 | 88.2 | 57.5 | 82.5 | 9.8 |
| | 70 | 6.0 | 48.1 | 44.4 | 71.9 | 75.0 | 109.1 | 58.6 | 67.9 | 9.7 |
| | 107 | 2.0 | 110.6 | 97.2 | 109.1 | 86.0 | 136.8 | 87.4 | 104.5 | 7.7 |
| | 107 | 6.0 | 75.2 | 90.7 | 165.7 | 49.7 | 125.3 | 60.5 | 94.5 | 17.9 |
| | 157 | 6.0 | 36.2 | 88.4 | 95.2 | 79.8 | 83.4 | 104.1 | 81.2 | 9.7 |
| | 163 | 6.0 | 39.7 | 72.3 | 40.3 | 14.8 | 81.1 | 89.2 | 56.2 | 11.8 |
| | 177 | 6.0 | 42.1 | 80.8 | 103.4 | 96.5 | 94.5 | 106.1 | 87.2 | 9.7 |

An about 70% reduction of SCAP mRNA is achieved after a single 6 mg/kg dose of GalXC™-SCAP oligonucleotide nos. 70 and 163, an about 60% reduction of SCAP mRNA is achieved after a single 6 mg/kg dose of GalXC-SCAP oligonucleotide nos. 107, 157 and 177, and an about 50% reduction of SCAP mRNA is achieved after a single 6 mg/kg dose of GalXC™-SCAP oligonucleotide no. 66. Moreover, a dose response is observed following the 2 mg/kg and 6 mg/kg dose of GalXC™-SCAP oligonucleotide no. 107, where the $ED_{50}$ is about 2 mg/kg. Likewise, a sustained reduction of liver SCAP mRNA expression is observed 56 days post a single 6.0 mg/kg dose of the GalXC™-SCAP oligonucleotides. An about 50% reduction of SCAP mRNA is observed 84 days after a single dose of GalXC™-SCAP oligonucleotide nos. 70 and 163.

Taken together, these results show that GalXC™-SCAP oligonucleotides designed to target human and NHP SCAP mRNA inhibit SCAP activity in vivo (as determined by the reduction of the amount of SCAP mRNA in treated animals).

SEQUENCES

The following nucleic and/or amino acid sequences are referred to in the disclosure and are provided below for reference.

```
SEQ ID NO: 1-wild-type human SCAP (4254 bp; NCBI Ref. Seq. No. NM_012235.4)
gggcacccggcggccaggagagagagggagggogccacgcaccggactgcgggccgagagcgcgcacgccgcgctccgccc
ctgctgccgcccccgtcgccgccgccgccgccgccgcagcttgggaggtgctgccaccacaggtacctgcacatgttgttctttgtca
gtgctgtcaagtgtgtgccagggtgatccatggtcactttccgggatggcagcaaggtgacttcggctgaggatgaccctgactgaaa
ggctgcgtgagaagatatctcgggccttctacaaccatgggctcctctgtgcatcctatcccatccccatcatcctcttcacagggttctg
catcttagcctgctgctacccactgctgaaactccccttgccaggaacaggacctgtggaattcaccacccctgtgaaggattactcgc
ccccacctgtggactctgaccgcaaacaaggagagcctactgagcagcctgagtggtatgtgggtgccccggtggcttatgtccagc
agatatttgtgaagtcctcagtgtttccctggcacaagaacctcctggcagtagatgtatttcgttcacctttgtcccgggcattccaactg
gtggaggagatccggaaccacgtgctgagagacagctctgggatcaggagcttggaggagttgtgtctgcaagtgaccgacctgct
gccaggccttaggaagctcaggaacctactccctgagcatggatgcctgctgctgtcccctgggaacttctggcagaatgactgggaa
cgcttccatgctgatcctgacatcattgggaccatccaccagcacgagcctaaaaccctgcagacttcagccacactcaaagacttgtt
atttggtgttcctgggaagtacagcggggtgagcctctacaccaggaagaggatggtctcctacaccatcaccctggtcttccagcact
accatgccaagttcctgggcagcctgcgtgcccgcctgatgcttctgcaccccagccccaactgcagccttcgggcggagagcctgg
tccacgtgcacttcaaggaggagattggtgtcgctgagctcatccccttgtgaccacctacatcatcttgtttgcctacatctacttctcca
cgcggaagatcgacatggtcaagtccaagtgggggctggccctggctgccgtggtcacagtgctcagctcgctgctcatgtctgtgg
gactctgcacactcttcggcctgacgcccaccctcaatggcggcgagatttcccctaccttgtggtggttattgggttagagaatgtgtt
ggtgctcaccaagtctgtggtctcaaccccggtagacctggaggtgaagctgcggatcgcccaaggcctaagcagcgagagctggt
ccatcatgaagaacatggccacggagctgggcatcatcctcatcggctacttcaccctagtgcccgccatccaggagttctgtctctttg
ctgtcgtggggctggtgtctgacttcttccttcagatgctgtttttcaccactgtcctgtccattgacattcgccggatggagctagcagac
ctgaacaagcgactgccccctgaggcctgcctgccctcagccaagccagtgggacagccaacgcgctacgagcggcagctggctg
tgaggccgtccacaccccacaccatcacgttgcagccgtcttccttccgaaacctgcggctccccaagaggctgcgtgttgtctacttc
ctggcccgcacccgcctggcacagcgcctcatcatggctggcaccgttgtctggattggcatcctggtatacacagacccagcaggg
```

-continued ctgcgcaactacctcgctgcccaggtgacggaacagagcccattgggtgagggagccctggctcccatgcccgtgcctagtggcat
gctgcccccccagccacccggaccctgccttctccatcttcccacctgatgcccctaagctacctgagaaccagacgtcgccaggcga
gtcacctgagcgtggaggtccagcagaggttgtccatgacagcccagtcccagaggtaacctgggggcctgaggatgaggaacttt
ggaggaaattgtccttccgccactggccgacgctcttcagctattacaacatcacactggccaagaggtacatcagcctgctgcccgtc
atcccagtcacgctccgcctgaacccgagggaggctctggagggccggcaccctcaggacggccgcagtgcctggcccccaccg
gggcccatacctgctgggcactgggaagcaggacccaagggcccaggtggggtgcaggcccatggagacgtcacgctgtacaag
gtggcggcgctgggcctggccaccggcatcgtcttggtgctgctgctgctctgcctctaccgcgtgctatgcccgcgcaactacgggc
agctgggtggtgggcccgggggcggaggcgcggggagctgccctgcgacgactacggctatgcgccacccgagacggagatc
gtgccgcttgtgctgcgcggccacctcatggacatcgagtgcctggccagcgacggcatgctgctggtgagctgctgcctggcaggc
cacgtctgcgtgtgggacgcgcagaccggggattgcctaacgcgcattccgcgcccaggcaggcagcgccgggacagtggcgtg
ggcagcgggcttgaggctcaggagagctgggaacgactttcagatggtgggaaggctggtccagaggagcctggggacagccctc
ccctgagacaccgcccccggggccctccgccgccttccctcttcggggaccagcctgacctcacctgcttaattgacaccaacttttca
gcgcagcctcggtcctcacagcccactcagcccgagccccggcaccgggggtctgtggccgctctcgggactccccaggctatg
acttcagctgcctggtgcagcgggtgtaccaggaggaggggctggcggccgtctgcacaccagccctgcgcccaccctcgcctgg
gccggtgctgtcccaggcccctgaggacgagggtggctcccccgagaaaggctccccttccctcgcctgggcccccagtgccgag
ggttccatctggagcttggagctgcagggcaacctcatcgtggtggggcggagcagcggccggctggaggtgtgggacgccattga
aggggtgctgtgctgcagcagcgaggaggtctcctcaggcattaccgctctggtgttcttggacaaaaggattgtggctgcacggctc
aacggttcccttgatttcttctccttggagacccacactgccctcagcccccctgcagtttagagggaccccagggcggggcagttcccc
tgcctctccagtgtacagcagcagcgacacagtggcctgtcacctgacccacacagtgccctgtgcacaccaaaaacccatcacagc
cctgaaagccgctgctgggcgcttggtgactgggagccaagaccacacactgagagtgttccgtctggaggactcgtgctgcctcttc
acccttcagggccactcaggggccatcacgaccgtgtacattgaccagaccatggtgctggccagtggaggacaagatggggccat
ctgcctgtgggatgtactgactggcagccgggtcagccatgtgtttgctcaccgtggggatgtcacctcccttacctgtaccacctcctg
tgtcatcagcagtggcctggatgacctcatcagcatctgggaccgcagcacaggcatcaagttctactccattcagcaggacctgggc
tgtggtgcaagcttgggtgtcatctcagacaacctgctggtgactggcggccagggctgtgtctccttttgggacctaaactacgggga
cctgttacagacagtctacctggggaagaacagtgaggcccagcctgcccgccagatcctggtgctggacaacgctgccattgtctg
caactttggcagtgagctcagcctggtgtatgtgccctctgtgctggagaagctggactgagcgcagggcctccttgcccaggcagga
ggctggggtgctgtgtgggggccaatgcactgaacctggacttgggggaaagagccgagtatcttccagccgctgcctcctgactgt
aataatattaaactttttttaaaaaaccatatcatcatctgtcaggcactttgggagcta SEQ ID NO: 2-wild-type human SCAP (1279 aa; NCBI Ref. Seq. No. NP_036367.2)
MTLTERLREKISRAFYNHGLLCASYPIPHILFTGFCILACCYPLLKLPLPGTGPVEFTTPV
KDYSPPPVDSDRKQGEPTEQPEWYVGAPVAYVQQIFVKSSVFPWHKNLLAVDVFRS
PLSRAFQLVEEIRNHVLRDSSGIRSLEELCLQVTDLLPGLRKLRNLLPEHGCLLLSPGN
FWQNDWERFHADPDIIGTIHQHEPKTLQTSATLKDLLFGVPGKYSGVSLYTRKRMVS
YTITLVFQHYHAKFLGSLRARLMLLHPSPNCSLRAESLVHVHFKEEIGVAELIPLVTT
YIILFAYIYFSTRKIDMVKSKWGLALAAVVTVLSSLLMSVGLCTLFGLTPTLNGGEIFP
YLVVVIGLENVLVLTKSVVSTPVDLEVKLRIAQGLSSESWSIMKNMATELGIILIGYFT
LVPAIQEFCLFAVVGLVSDFFLQMLFFTTVLSIDIRRMELADLNKRLPPEACLPSAKPV
GQPTRYERQLAVRPSTPHTITLQPSSFRNLRLPKRLRVVYFLARTRLAQRLIMAGTVV
WIGILVYTDPAGLRNYLAAQVTEQSPLGEGALAPMPVPSGMLPPSHPDPAFSIFPPDA
PKLPENQTSPGESPERGGPAEVVHDSPVPEVTWGPEDEELWRKLSFRHWPTLFSYYN
ITLAKRYISLLPVIPVTLRLNPREALEGRHPQDGRSAWPPPGPIPAGHWEAGPKGPGG
VQAHGDVTLYKVAALGLATGIVLVLLLLCLYRVLCPRNYGQLGGGPGRRRRGELPC
DDYGYAPPETEIVPLVLRGHLMDIECLASDGMLLVSCCLAGHVCVWDAQTGDCLTR
IPRPGRQRRDSGVGSGLEAQESWERLSDGGKAGPEEPGDSPPLRHRPRGPPPPSLFGD
QPDLTCLIDTNFSAQPRSSQPTQPEPRHRAVCGRSRDSPGYDFSCLVQRVYQEEGLAA
VCTPALRPPSPGPVLSQAPEDEGGSPEKGSPSLAWAPSAEGSIWSLELQGNLIVVGRSS
GRLEVWDAIEGVLCCSSEEVSSGITALVFLDKRIVAARLNGSLDFFSLETHTALSPLQF
RGTPGRGSSPASPVYSSSDTVACHLTHTVPCAHQKPITALKAAAGRLVTGSQDHTLR
VFRLEDSCCLFTLQGHSGAITTVYIDQTMVLASGGQDGAICLWDVLTGSRVSHVFAH
RGDVTSLTCTTSCVISSGLDDLISIWDRSTGIKFYSIQQDLGCGASLGVISDNLLVTGG
QGCVSFWDLNYGDLLQTVYLGKNSEAQPARQILVLDNAAIVCNFGSELSLVYVPSVL
EKLD SEQ ID NO: 3-wild-type mouse SCAP (4226 bp; NCBI Ref. Seq. No.
NM_001001144.3)
gttgagaggtgaagggggggagctgcgcgggcgccgggggccgggagggagaggggggctccaaacaccggaccgcg
ggccaggagcgcgcaggccgttctccgccgctcggtcgccgccgcccgggagctgcctcgctgccacaggtgcctgcagatgatg
tctgctgtaagtgatatccagcatcttccgggctgatccatggtcactttccgggatggcaacaaggtgacttagccgaggatgaccctg
actgaaaggcttcgtgagaagatatctcaggccttctacaaccatgggctgctctgcgcatcctatccaattcccatcatcctcttcacag
gactctgcatcttagcctgctgctacccgctgctgaagctccccttgcctggaacgggacctgtggaattctccacgcctgtgaagggtt
actcgcccccgcctgcggactctgaccacaaacaaggagagcccagcgagcagccagagtggtatgtgggtgcccccgtggcgta
catccaacagatatttgtgaagtcatcggtgtctccctggcacagaaatcttctggcagtcgatgtgttccggtcacctctgtcccgagca
ttccaactggtggaagagatccggaaccatgtgctgagagacagctcagggaccaagagcctggaggaggtttgcctgcaggtgac
agacctgctgccaggcctcaggaaactccggagcctacttcccgaacatggctgcctgctgctgtcccctgggaacttctggcagaat
gattgggagagattccatgccgaccctgacatcattgggaccatccatcaacatgagcccaaaactctacagacatcagccacactca
aagacttgctgtttggtgttcctgggaagtacagtggggtgagcctctacacaaggaaaaggatggtctcctacaccatcaccctggtct
tccagcgctaccatgccaagtttctgagcagcctacgtgcccggctcatgctgctgcaccccagccccaactgcagcctccgagcag
agaacctggtccacgtccacttcaaagaggagattggcattgctgagctcatcccgctcgtgaccacctacatcatcctgtttgcctacat
ctacttctccacacgcaagatcgacatggtcaagtccaagtggggcctcgccctggcagccgtggtcacagtacttagctcactgctca
tgtctgtggggctctgcaccctcttcggcctgacgcccacactcaatggcggtgagatcttcccatacctggtggtcgttattgggctag
agaacgtgttggtgctcaccaagtcagtggtatcaactccagtggacctcgaggtgaagcttcggattgcacaaggcttgagtagtgag
agctggtccatcatgaagaacgcggcgaccgagctgggcatcatcctcattggctacttcaccctcgtgcctgctatccaggagttctg
cctctttgctgttgtgggcctggtgtctgacttcttcctccagatgctgttcttcaccactgtcctgtcgatcgacattcgccggatggagct
agcagacctaaacaagcggctgccccctgaatcctgcctgccctcagccaagcccgtggggaggccagcacgatatgagagacag
caggctgtacggccatccacgccacacaccatcacattgcaaccatcttccttccgaaacctgcggcttcccaaaaggctgcgtgtcat
ctacttcctggcccgcactcgcctggcccagcgcctcatcatggctggtaccgttgtctggattggcatcctggtatacaccgacccgg
cagggctgcgcacctaccttgctgcccaggtgacagagcagagcccactgggtgagggttccctgggccccatgcctgtgcctagc
ggagtgctgcctgccagccacccggaccctgcattctccatcttcccacctgatgctcctaaactgccagagaaccagaccttgccag -continued gtgagctgcctgagcatgctggtccagcagagggtgtccatgacagccgagccccagaggtaacttgggggcctgaggatgagga
gctgtggaggaaattgtccttccgccactggcccacactcttcaactactacaacatcacactggccaaaaggtacatcagcctgctgc
ctgtcatccctgtcacactacacctgaatccacgggaggctctggaggggcgacaccctcaggatggtcgcagtgcctgggccccac
aagagcctttgcccgctggcctctgggagtccggacctaagggaccaggtggaacacagacccatggcgacattaccttgtacaagg
tggccgcgcttggcctagcagcgggcatcgtcctggtgctgctgctgctctgcctctaccgggtgctctgcccgcgtaattatgggcag
ccgggtggtggccccggcaggcggaggcgcggggagctgccctgcgatgactacggctacgcaccgcccgagacggagatagt
gccgctggtgctgcgaggtcacctcatggacatcgagtgtctggctagcgatgggatgctactagtgagctgctgcctggcaggcca
agtctgcgtgtgggacgctcagacaggggactgcctcacacggatcccacgcccagggccacgccgggatagctgcggaggtgg
agcttttgagactcaggagaactgggaaaggctgtcagatggaggcaaggctagcccggaagaacctggagacagccctccgctg
cgacgacgcccccgagggcctccaccgccttccctctttggggaccagcccgacctcacctgcttaatcgacaccaacttctcggtgc
agctgcccccagagcccactcagcccgagcctcggcaccgggtgggctgtggccgctctagagactcgggttatgacttcagccgc
ctggtgcagcgtgtgtaccaggaggaaggcctggctgctatgcgcatgccggccctgcgcccaccctcccctggacctcccttgccc
caggcctctcaagaagaggggactgcacctgagaagggctcccctcccctggcctggacccccagcacagccggttccatctggag
cttagagctgcaaggcaatctcatcgtggttgggcggagcagcggccggctggaggtgtgggacgccattgaggggtgctctgct
gcagcaatgaggagatctcctcaggcatcacagcccttgtcttcttggacaggaggattgtagctgctcggcttaatggttcccttgattt
cttttctttggagacccacacttccctcagcccctgcagttcagagggaccccagggcgaggcagttctccttcctcatctgtgtacag
cagcagcaacacagtgacctgtcatcggacccacacagtgccctgtgcacaccagaagcccatcacagccctgagagctgctgccg
ggcgcctagtgacagggagccaagaccatactctaagagtcttccgactggatgactcgtgttgcctctttaccctgaagggccactca
ggggcaatcacagctgtgtacattgatcagaccatggtactggccagtggaggacaagatggagccatctgcctgtgggatgtactaa
caggcagccgggtcagccaaacatttgctcaccgtggagatgttacctccctcacctgtaccgcttcctgtgtcattagtagtggcctgg
atgacttcatcagtatctgggaccgcagcacaggcatcaagctgtactccattcagcaggacctgggctgtggtgcaagcttgggtgtc
atctcagataaccttctggtgaccggcggccagggctgtgtctccttttgggacctaaactatggggacctgttacagacagtctacttg
ggcaagaacagtgaagcccagcctgcccggcagattttggtgttggacaatgctgccattgtctgcaactttggcagtgagctcagcct
agtgtatgtgccctctgtgctggagaaactggactgaaggcaggtcaagtacgctattccctttcccccatcccaaggtggggcacag
gggatagcaactctttggacctagactagaggcaatagctgactctgaactgttgtctcctgactgtaataataaactttttttaaaaaacca
cattt SEQ ID NO: 4-wild-type mouse SCAP (1276 aa; NCBI Ref. Seq. No.
NP_001001144.2)
MTLTERLREKISQAFYNHGLLCASYPIPIILFTGLCILACCYPLLKLPLPGTGPVEFSTP
VKGYSPPPADSDHKQGEPSEQPEWYVGAPVAYIQQIFVKSSVSPWHRNLLAVDVFRS
PLSRAFQLVEEIRNHVLRDSSGTKSLEEVCLQVTDLLPGLRKLRSLLPEHGCLLLSPG
NFWQNDWERFHADPDIIGTIHQHEPKTLQTSATLKDLLFGVPGKYSGVSLYTRKRMV
SYTITLVFQRYHAKFLSSLRARLMLLHPSPNCSLRAENLVHVHFKEEIGIAELIPLVTT
YIILFAYIYFSTRKIDMVKSKWGLALAAVVTVLSSLLMSVGLCTLFGLTPTLNGGEIFP
YLVVVIGLENVLVLTKSVVSTPVDLEVKLRIAQGLSSESWSIMKNAATELGIILIGYFT
LVPAIQEFCLFAVVGLVSDFFLQMLFFTTVLSIDIRRMELADLNKRLPPESCLPSAKPV
GRPARYERQQAVRPSTPHTITLQPSSFRNLRLPKRLRVIYFLARTRLAQRLIMAGTVV
WIGILVYTDPAGLRTYLAAQVTEQSPLGEGSLGPMPVPSGVLPASHPDPAFSIFPPDAP
KLPENQTLPGELPEHAGPAEGVHDSRAPEVTWGPEDEELWRKLSFRHWPTLFNYYNI
TLAKRYISLLPVIPVTLHLNPREALEGRHPQDGRSAWAPQEPLPAGLWESGPKGPGG
TQTHGDITLYKVAALGLAAGIVLVLLLLCLYRVLCPRNYGQPGGGPGRRRRGELPCD
DYGYAPPETEIVPLVLRGHLMDIECLASDGMLLVSCCLAGQVCVWDAQTGDCLTRIP
RPGPRRDSCGGGAFETQENWERLSDGGKASPEEPGDSPPLRRRPRGPPPPSLFGDQPD
LTCLIDTNFSVQLPPEPTQPEPRHRVGCGRSRDSGYDFSRLVQRVYQEEGLAAMRMP
ALRPPSPGPPLPQASQEEGTAPEKGSPPLAWTPSTAGSIWSLELQGNLIVVGRSSGRLE
VWDAIEGVLCCSNEEISSGITALVFLDRRIVAARLNGSLDFFSLETHTSLSPLQFRGTP
GRGSSPSSSVYSSSNTVTCHRTHTVPCAHQKPITALRAAAGRLVTGSQDHTLRVFRL
DDSCCLFTLKGHSGAITAVYIDQTMVLASGGQDGAICLWDVLTGSRVSQTFAHRGD
VTSLTCTASCVISSGLDDFISIWDRSTGIKLYSIQQDLGCGASLGVISDNLLVTGGQGC
VSFWDLNYGDLLQTVYLGKNSEAQPARQILVLDNAAIVCNFGSELSLVYVPSVLEKL
D SEQ ID NO: 5-wild-type rat SCAP (4281 bp; NCBI Ref. Seq. No. NM_001100966.2)
gaaggggggggagctgcgcgggcgccgggcggccgggagggagagggggctcgaaacaccggatcgcgggccaggag
cgcgcaggccgctctccgccgctccgtcgccgccgcccgggagctgcctcgccgccacaggcacctctcccgtggttggaggaaa
cgaggcattctagaaggggatagcaggtacctgcagatgatgtgcattgtcattggtatccagcatcttccaggctgatccatggtcact
ttccgggatggcaacaaggtgacttagctgaggatgaccctgactgaaaggcttcgtgagaagatatctcaggcgttctacaaccatg
ggctgctctgcgcatcctaccccattcccatcatcctcttcacaggactctgcatcctagcctgctgctacccgctgctgaagcttccctt g
cctggaacgggacccgtggaattctccacgcctgtgaagggttactcgcccccgcctgcggactctgaccacaaacaaggagagcc
cagtgagcagccagagtggtatgtgggtgcccccgtggcatacatccagcagatattcgtgaagtcatcagtgtctccctggcacaga
aaccttctggcagtagatgtgttccggtcacctctgtcccgagcattccaactggtggaagagatccggaaccatgtgctgagagacag
ctcagggaccaagagcctggaggaagtttgcctgcaggtgacagacctgctgccaggcctcaggaaactccggagcctacttcccg
aacatggctgcctgctgctgtcacctgggaacttctggcagaatgactgggaaagattccatgctgaccctgacatcattggaaccatc
catcagcatgagcctaaaaccctacagacatcagccacactcaaagacttgctgttcggtgttcctgggaagtacagtggggtcagcct
ctacacgaggaagaggatggtctcatacaccatcaccctggtcttccagcgctaccatgccaagtttctgagcagcctccgtgcccgg
ctcatgcttctgcaccccagccccaactgcagcctccgagcagagaacctggtgcatgtgcacttcaaagaggagattggcattgccg
agctcatccccctcgtgaccacctacatcatcctgtttgcctacatctacttctccacacgcaagatcgacatggtcaagtccaagtggg
gcctcgccctggcagccgtggtcacagtgcttagctcgctgctcatgtctgtggggctctgcactctcttcggcctgacgcccacactc
aatggcggcgagattttcccatatctggtggtggttattgggctagagaatgtgttggtgctcaccaagtcagtggtatcaactccagtgg
accttgaggtgaagcttcgaattgcacaaggcttaagcagtgagagctggtccatcatgaagaacgtagcaactgaactgggcatcat
cctcattggctacttcacccttgtgcctgccatccaagagttctgcctctttgctgtggtgggcctggtgtctgacttcttcctccagatgct
gttcttcaccaccgtgctgtccatcgacattcgccggatggagctagcagacctgaacaagcggctgccccctgagtcctgcctgccct
cagccaagcctgtggggaggccagcccgatatgagagacagctagctgtacggccgtccacaccacacaccatcacattgcaacca
tcttccttccgaaacctgcggcttcccaaaaggctgcgtgtcatctacttcctggcccgcactcgcctggcacagcgcctcatcatggct
ggtacagttgtctggattggcatcctggtatatacagacccggcagggctgcgcacctacctcgctgcccaggtgacagaacagagc
ccactgggtgagggttccctggggcccatgcctgtgcctagtggagtgctgcctgccagccacccggaccctgccttctccatcttccc
acctgatgctcctaaactgccagagaaccagacgttgccaggtgagctgcctgagcatgccgttccagcagagggcgtccaggaca
gccgagccccagaggtgacttgggggcccgaggatgaggagctgtggaggaaattgtccttccgccactggcccacactcttcaact -continued actataatatcacactggccaaaaggtacatcagcctgctgcctgtcatccctgtcacactacacctgaatccacgggaggctctggag
gggcgacaccctcaggatggccgcactgcctgggccccaccagagcctttgcctgctggcctgtgggagaccggacctaaggggc
caggtggaacacagacccatggcgacattaccttgtacaaggtggctgcacttggcctggcagcgggcattgtcctagtgctgctgct
gctctgcctctaccgggtgctctgcccgcgaaactacgggcagccgggtggtggtgcgggcaggcggaggcgcggagagctgcct
tgcgatgactatggctacgcaccgcctgagacggagatagtgccgctggtgctgcgagggcacctcatggacatcgagtgtctggct
agcgatgggatgctcctggtgagctgctgcctggctggccaagtctgcgtgtgggatgcacagaccggggactgcctcactcgcatc
ccgcgccctgggccacgccgggacagctgcggaggcggagcttttgaagctcaggagaactgggaaagactgtctgatgggggc
aaagctagcccggaagagcctggcgacagccctccgctgcgacgccgccctcgagggcctccaccgccttccctctttggggacca
gccagacctcacctgcttaatcgacaccaacttctcagtgcagctgcccccagagcccactcagcccgagcctcggcaccgggcgg
gctgtggccgctctagagactctggttacgacttcagccgtctggtgcagcgtgtgtaccaagaggaaggcctggctgctgtgcacat
gtcggccctgcgcccaccctccccgggacctcccctgccccaggcctctcaagaagaggggactgctcccgagaagggctccccc
cctctggcctgggccccagcacagccggttccatctggagcttagagttgcaaggcagtctcatcgtggttggcgaagcagcggc
cggctggaggtgtgggatgccattgagggcgtgctctgctgcagcaatgaggagatctcctcaggcatcacagcccttgtcttcttaga
gaccccagggagaggcagttctccttcctcgcctgtgtacagcagcagcaacactgtggcctgtcacctgacccacacagtcccctgt
gcacaccagaaacccatcacagccctgagagcagcagcggggcgcctggtgacagggagccaagaccatactctgagagtcttcc
gactggaggattcgtgttgcctctttaccctgcagggccactcgggggcaatcacaactgtgtacattgatcagaccatggtattggcca
gtggaggacaagatggagccatctgcctgtgggatgtactaacaggcagccgggtcagccatacatttgctcaccgtggagatgtca
cctccctcacctgtaccacttcctgtgttatcagtagtggcctggatgacttcatcaacatctgggaccgaagcacaggcatcaagctgt
actccattcagcaggacctgggctgtggtgcaagcttgggtgtcatctctgataaccttctggtgaccggcggccagggatgtgtctcct
tttgggacctaaactatggggacctgttacagacagtctacttgggaaagaacagtgaagcccagcctgcccggcagattttggtgctg
gacaatgctgccattgtctgcaactttggcagtgagctcagcctagtgtatgtgccctctgtgctggagaaactggactgaaggcaggt
caactgcactatgcctttccccatcccaaggtggggcactggggattgcaactctttggacctagactggaggcaataggtaggcatc
tttgcagctgactcagaactgttgtctcctgactgtaataataaactttttttaaaaaaccaca SEQ ID NO: 6-wild-type rat SCAP (1276 aa; NCBI Ref. Seq. No. NP_001094436.1)
MTLTERLREKISQAFYNHGLLCASYPIPIILFTGLCILACCYPLLKLPLPGTGPVEFSTP
VKGYSPPPADSDHKQGEPSEQPEWYVGAPVAYIQQIFVKSSVSPWHRNLLAVDVFRS
PLSRAFQLVEEIRNHVLRDSSGTKSLEEVCLQVTDLLPGLRKLRSLLPEHGCLLLSPG
NFWQNDWERFHADPDIIGTIHQHEPKTLQTSATLKDLLFGVPGKYSGVSLYTRKRMV
SYTITLVFQRYHAKFLSSLRARLMLLHPSPNCSLRAENLVHVHFKEEIGIAELIPLVTT
YIILFAYIYFSTRKIDMVKSKWGLALAAVVTVLSSLLMSVGLCTLFGLTPTLNGGEIFP
YLVVVIGLENVLVLTKSVVSTPVDLEVKLRIAQGLSSESWSIMKNVATELGIILIGYFT
LVPAIQEFCLFAVVGLVSDFFLQMLFFTTVLSIDIRRMELADLNKRLPPESCLPSAKPV
GRPARYERQLAVRPSTPHTITLQPSSFRNLRLPKRLRVIYFLARTRLAQRLIMAGTVV
WIGILVYTDPAGLRTYLAAQVTEQSPLGEGSLGPMPVPSGVLPASHPDPAFSIFPPDAP
KLPENQTLPGELPEHAVPAEGVQDSRAPEVTWGPEDEELWRKLSFRHWPTLFNYYNI
TLAKRYISLLPVIPVTLHLNPREALEGRHPQDGRTAWAPPEPLPAGLWETGPKGPGGT
QTHGDITLYKVAALGLAAGIVLVLLLLCLYRVLCPRNYGQPGGGAGRRRRGELPCD
DYGYAPPETEIVPLVLRGHLMDIECLASDGMLLVSCCLAGQVCVWDAQTGDCLTRIP
RPGPRRDSCGGGAFEAQENWERLSDGGKASPEEPGDSPPLRRRPRGPPPPSLFGDQPD
LTCLIDTNFSVQLPPEPTQPEPRHRAGCGRSRDSGYDFSRLVQRVYQEEGLAAVHMS
ALRPPSPGPPLPQASQEEGTAPEKGSPPLAWAPSTAGSIWSLELQGSLIVVGRSSGRLE
VWDAIEGVLCCSNEEISSGITALVFLDRRIVAARLNGSLDFFSLETHTSLSPLQFRGTP
GRGSSPSSPVYSSSNTVACHLTHTVPCAHQKPITALRAAAGRLVTGSQDHTLRVFRLE
DSCCLFTLQGHSGAITTVYIDQTMVLASGGQDGAICLWDVLTGSRVSHTFAHRGDVT
SLTCTTSCVISSGLDDFINIWDRSTGIKLYSIQQDLGCGASLGVISDNLLVTGGQGCVS
FWDLNYGDLLQTVYLGKNSEAQPARQILVLDNAAIVCNFGSELSLVYVPSVLEKLD SEQ ID NO: 7-wild-type non-human primate SCAP (4135 bp; NCBI Ref. Seq. No.
XM_001100342)
agggagagagagagagagtgtgtgtgtgtgagtgtgtgtgtgtattttggaattgatgtcactagaacttacatacaggcattctgaaa
ccattccccagccacataactatcgcctccctccagcagccctagtgtgcagagccaagtactctttgttaactggcttttctcccttctga
ccaggtacctgcacatgttgttctttgtcagtgccgtcaagtgtgtgccagggtgatccatggtcactttccgggatggcagcaaggtga
cttcggctgaggatgaccctgactgaaaggctgcgtgagaagatatctcgggccttctacaaccatgggctcctctgtgcatcgtatcc
catccccatcatcctcttcacggggttctgcatcttagcctgctgctacccactgctgaaactccccttgccaggaacaggacctgtgga
attcaccacccctgtaaaggattactcgcccccgcctgtggactctgaccgcaaacaaggagagcctacggagcagcctgagtggta
tgtgggtgccccggtggcttacgtccagcagatatttgtgaaatcctcagtgtttccctggcacaagaacctcctggcagtagatgtattt
cgttcacctttgtcccgggcattccaactggtggaggagatccggaaccacgtgctgagagacagctctgggaccaggagcttggag
gagttgtgtctgcaagtgaccgacctgctgccaggcctcaggaagctcagggacctactccctgagcatggatgcctgctgctgtccc
ctgggaatttctggcagaatgaccgggaacgcttccatgctgatcctgacatcattgggaccatccaccagcacgagcctaaaaccct
gcagacttcagccacactcaaagacttgttgtttggtgttcccgggaagtacagcggggtgagcctctacaccaggaagaggatggtc
tcctacaccatcaccctggtcttccagcgctaccatgccaagttcctgggcagcctgcgtgcccgcctgatgcttctgcaccccagccc
caactgcagccttcgggcggagagcctggtccacgtgcacttcaaggaggagattggtgtcgctgagctcatccccttgtgaccacc
tacatcatcttgtttgcctacatctacttctccacgcggaagatcgacatggtcaagtccaagtgggggctggccctggccgccgtggtc
acagtgctcagctcgctgctcatgtctgtgggactctgcacactcttcggcctgacgcccaccctcaatggcggcgagattttcccctac
cttgtggtggttattgggttagagaatgtgttggtgctcaccaagtccgtggtctcaaccccggtagacctggaggtgaagctgcggatc
gcccaaggcctaagcagcgagagctggtccatcatgaagaacatggccacggagctgggcatcatcctcattggctacttcaccta
gtgcctgccatccaggagttctgtctctttgctgtcgtggggctggtgtctgacttcttccttcagatgctgtttttcaccactgtcctgtccat
tgacattcgccggatggagctagcggacctgaacaagcggctgcccccgaggcctgcctaccctcagccaagccagtggggcag
ccaacgcgctacgagcggcagctggctgtgcggccgtccacaccccacaccatcacgttgcagccgtcttccttccgaaacctgcgg
ctccccaagaggctgcgtgttgtctacttcctggcccgcacccgcctggcacagcgtctcatcatggctggcaccgttgtctggattgg
catcctggtatacacagacccagcagggctgcgcacctacctcgctgcccaggtgacggaacagagcccgctgggtgagggagcc
ctggctcccatgcccgtgcctagtggcatgctgcccgccagccacccggaccctgccttctccatcttcccacctgatgcccctaagct
acctgagaaccagacatcgccaggcgagccacctgagcatggaggtccagcagaggttgtccatgacagcccagtcccagaggta
acctgggggcctgaggatgaggaactttggaggaaattgtccttccgccactggccgacgctcttcagctattacaacatcacgctggc
caagaggtacatcagcctgctgcctgtcatcccagtcacactccgcctgaacccgagggaggccctggagggccggcaccctcagg
atggccgcagtgcctggcccccaccggggcccatacctgctgggcactgggaagcgggacccaagggcccaggtggggtgcag
gcccatggagacgtcacactgtacaaggtggcgnnnnnnnnnnnnnnnnnttgtgccgctggtcctgcgcggccacctcatggata
tcgagtgcctggccagcgacggcatgctgctggtgagctgttgcctggcaggccacgtctgtgtgtgggacgcacagaccggggatt -continued

```
gcctcacgcgtatcccgcgcccagggcagcgccgggacagtggcgtgggcagcgggcttgaggctcaggagagctgggaacga
ctttcagatggtgggaaggctggcccagaggagcctggggacagccctcccctgagacaccgcccccgggaccctccaccgcctt
ccctcttcggggaccagcctgacctcacctgcttaattgacaccaacttttcggcgcagccacagccctcacagcccactcagcctga
gccccggcaccgggcggtctgtggccgcgctcgggactccctaggctatgacttcagccgcctggtgcagcgcgtgtaccaggag
gaggggctggcggccgtctgcacaccagccctgcgcccacccctcgcctgggccggtgctgccccaggcccctgaggacgagggt
ggctcccctgagaaaggctcccccttcccttgcctgggcccccagtgcggagggttccatctggagcttggagctgcagggccacctc
atcgtggtggggcggagcagcggccggctggaggtgtgggacgccattgaaggggtgctgtgctgcagcagcgaggaggtctcct
caggcattaccgctctggtcttcttggacaaaaggattgtggctgcgcggctcaacggttcccttgatttcttctccttggagacccacact
gccctcagcccccctgcagtttagagggacccccggggcagggcagttcccctgcctctccagtgtacggcagcagtgacacagtggc
ctgtcgcctgacccacacagtgccctgtgcacaccaaaaacccatcacagccctgaaagccgctgccgggcgcttggtgactggga
gtcaagaccacacgctgagagtattccgtctggaggactcgtgctgcctcttcacccttcagggccactcgggggccatcacgactgt
gtacattgaccagaccatggtgctggccagtggaggacaagatggggccatctgcctgtgggatgtactgactggcagccgggtcag
ccacatgtttgctcaccgtggggatgtcacctccctcacctgtaccacctcctgtgtcatcagcagtggcctggatgacctcatcagcat
ctgggaccgcagcacaggcatcaagttctactccattcagcaggatctgggctgtggtgcaagcttgggtgtcatctcagacaacctgc
tggtgaccggcggccaaggctgtgtctcccttttgggacctaaactacggggacctgttacagacagtctacctggggaagaacagtga
ggcccagcctgcccgccagatcctggtgctggacaacgctgccattgtctgcaactttggcagtgagctcagcctggtgtatgtgccct
ccgtgctggagaagctggactgagcatggggcctccctgcccaggcaggggtctggggtgctgtgtgggggccaatgcactgaac
ctggacttgggggaaagagccgagtatcttccagccgctgcctcctgactgtaatattaaactttttttaaaaaaccacatctgtcaggcac
tttggga
```

SEQ ID NO: 8-wild-type non-human primate SCAP (1229 aa; NCBI Ref. Seq. No. XP_001100342.2)

```
MTLTERLREKISRAFYNHGLLCASYPIPIILFTGFCILACCYPLLKLPLPGTGPVEFTTPV
KDYSPPPVDSDRKQGEPTEQPEWYVGAPVAYVQQIFVKSSVFPWHKNLLAVDVFRS
PLSRAFQLVEEIRNHVLRDSSGTRSLEELCLQVTDLLPGLRKLRDLLPEHGCLLLSPG
NFWQNDRERFHADPDIIGTIHQHEPKTLQTSATLKDLLFGVPGKYSGVSLYTRKRMV
SYTITLVFQRYHAKFLGSLRARLMLLHPSPNCSLRAESLVHVHFKEEIGVAELIPLVTT
YIILFAYIYFSTRKIDMVKSKWGLALAAVVTVLSSLLMSVGLCTLFGLTPTLNGGEIFP
YLVVVIGLENVLVLTKSVVSTPVDLEVKLRIAQGLSSESWSIMKNMATELGIILIGYFT
LVPAIQEFCLFAVVGLVSDFFLQMLFFTTVLSIDIRRMELADLNKRLPPEACLPSAKPV
GQPTRYERQLAVRPSTPHTITLQPSSFRNLRLPKRLRVVYFLARTRLAQRLIMAGTVV
WIGILVYTDPAGLRTYLAAQVTEQSPLGEGALAPMPVPSGMLPASHPDPAFSIFPPDA
PKLPENQTSPGEPPEHGGPAEVVHDSPVPEVTWGPEDEELWRKLSFRHWPTLFSYYN
ITLAKRYISLLPVIPVTLRLNPREALEGRHPQDGRSAWPPPGPIPAGHWEAGPKGPGG
VQAHGDVTLYKVAXXXXXXVPLVLRGHLMDIECLASDGMLLVSCCLAGHVCVWD
AQTGDCLTRIPRPGQRRDSGVGSGLEAQESWERLSDGGKAGPEEPGDSPPLRHRPRD
PPPPSLFGDQPDLTCLIDTNFSAQPQPSQPTQPEPRHRAVCGRARDSLGYDFSRLVQR
VYQEEGLAAVCTPALRPPSPGPVLPQAPEDEGGSPEKGSPSLAWAPSAEGSIWSLELQ
GHLIVVGRSSGRLEVWDAIEGVLCCSSEEVSSGITALVFLDKRIVAARLNGSLDFFSLE
THTALSPLQFRGTPGQGSSPASPVYGSSDTVACRLTHTVPCAHQKPITALKAAAGRL
VTGSQDHTLRVFRLEDSCCLFTLQGHSGAITTVYIDQTMVLASGGQDGAICLWDVLT
GSRVSHMFAHRGDVTSLTCTTSCVISSGLDDLISIWDRSTGIKFYSIQQDLGCGASLGV
ISDNLLVTGGQGCVSFWDLNYGDLLQTVYLGKNSEAQPARQILVLDNAAIVCNFGSE
LSLVYVPSVLEKLD
```

SEQ ID NOS: 9-392 - GalXC™-SCAP Oligonucleotides (unmodified)

| GalXC-SCAP Oligo | Sense Strand (passenger; 36-mer) | SEQ ID NO: | Antisense Strand (guide; 22-mer) | SEQ ID NO: |
|---|---|---|---|---|
| 1 | UGUUUGCCUACAUCUACUUAGCAGCCGAAAGGCUGC | 9 | UAAGUAGAUGUAGGCAAACAGG | 10 |
| 2 | GUUUGCCUACAUCUACUUCAGCAGCCGAAAGGCUGC | 11 | UGAAGUAGAUGUAGGCAAACGG | 12 |
| 3 | UUUGCCUACAUCUACUUCUAGCAGCCGAAAGGCUGC | 13 | UAGAAGUAGAUGUAGGCAAAGG | 14 |
| 4 | GCCUACAUCUACUUCUCCAAGCAGCCGAAAGGCUGC | 15 | UUGGAGAAGUAGAUGUAGGCGG | 16 |
| 5 | AAGAUCGACAUGGUCAAGUAGCAGCCGAAAGGCUGC | 17 | UACUUGACCAUGUCGAUCUUGG | 18 |
| 6 | AGAUCGACAUGGUCAAGUCAGCAGCCGAAAGGCUGC | 19 | UGACUUGACCAUGUCGAUCUGG | 20 |

-continued

SEQ ID NOS: 9-392 - GalXC™-SCAP Oligonucleotides (unmodified)

| GalXC-SCAP Oligo | Sense Strand (passenger; 36-mer) | SEQ ID NO: | Antisense Strand (guide; 22-mer) | SEQ ID NO: |
|---|---|---|---|---|
| 7 | AUCGACAUGGUCAAGUCCAAGCAGCCGAAAGGCUGC | 21 | UUGGACUUGACCAUGUCGAUGG | 22 |
| 8 | GUGUUGGUGCUCACCAAGUAGCAGCCGAAAGGCUGC | 23 | UACUUGGUGAGCACCAACACGG | 24 |
| 9 | UGUUGGUGCUCACCAAGUCAGCAGCCGAAAGGCUGC | 25 | UGACUUGGUGAGCACCAACAGG | 26 |
| 10 | GAGAGCUGGUCCAUCAUGAAGCAGCCGAAAGGCUGC | 27 | UUCAUGAUGGACCAGCUCUCGG | 28 |
| 11 | AGAGCUGGUCCAUCAUGAAAGCAGCCGAAAGGCUGC | 29 | UUUCAUGAUGGACCAGCUCUGG | 30 |
| 12 | GAGCUGGUCCAUCAUGAAGAGCAGCCGAAAGGCUGC | 31 | UCUUCAUGAUGGACCAGCUCGG | 32 |

-continued

SEQ ID NOS: 9-392 - GalXC™-SCAP Oligonucleotides (unmodified)

| GalXC-SCAP Oligo | Sense Strand (passenger; 36-mer) | SEQ ID NO: | Antisense Strand (guide; 22-mer) | SEQ ID NO: |
|---|---|---|---|---|
| 13 | AGCUGGUCCAUCAUGAAGAAGCAGCCGAAAGGCUGC | 33 | UUCUUCAUGAUGGACCAGCUGG | 34 |
| 14 | GCUGGUCCAUCAUGAAGAAAGCAGCCGAAAGGCUGC | 35 | UUUCUUCAUGAUGGACCAGCGG | 36 |
| 15 | CUGGUCCAUCAUGAAGAACAGCAGCCGAAAGGCUGC | 37 | UGUUCUUCAUGAUGGACCAGGG | 38 |
| 16 | CCGUUGUCUGGAUUGGCAUAGCAGCCGAAAGGCUGC | 39 | UAUGCCAAUCCAGACAACGGGG | 40 |
| 17 | UUGUCUGGAUUGGCAUCCUAGCAGCCGAAAGGCUGC | 41 | UAGGAUGCCAAUCCAGACAAGG | 42 |
| 18 | UGUCUGGAUUGGCAUCCUGAGCAGCCGAAAGGCUGC | 43 | UCAGGAUGCCAAUCCAGACAGG | 44 |
| 19 | GUCUGGAUUGGCAUCCUGGAGCAGCCGAAAGGCUGC | 45 | UCCAGGAUGCCAAUCCAGACGG | 46 |
| 20 | CUGGAUUGGCAUCCUGGUAAGCAGCCGAAAGGCUGC | 47 | UUACCAGGAUGCCAAUCCAGGG | 48 |
| 21 | UGGAUUGGCAUCCUGGUAUAGCAGCCGAAAGGCUGC | 49 | UAUACCAGGAUGCCAAUCCAGG | 50 |
| 22 | GGAUUGGCAUCCUGGUAUAAGCAGCCGAAAGGCUGC | 51 | UUAUACCAGGAUGCCAAUCCGG | 52 |
| 23 | GAUUGGCAUCCUGGUAUACAGCAGCCGAAAGGCUGC | 53 | UGUAUACCAGGAUGCCAAUCGG | 54 |
| 24 | AUUGGCAUCCUGGUAUACAAGCAGCCGAAAGGCUGC | 55 | UUGUAUACCAGGAUGCCAAUGG | 56 |
| 25 | CUCCAUCUUCCCACCUGAUAGCAGCCGAAAGGCUGC | 57 | UAUCAGGUGGGAAGAUGGAGGG | 58 |
| 26 | CAUCUGCCUGUGGGAUGUAAGCAGCCGAAAGGCUGC | 59 | UUACAUCCCACAGGCAGAUGGG | 60 |
| 27 | UCUGCCUGUGGGAUGUACUAGCAGCCGAAAGGCUGC | 61 | UAGUACAUCCCACAGGCAGAGG | 62 |
| 28 | GUGGUGCAAGCUUGGGUGUAGCAGCCGAAAGGCUGC | 63 | UACACCCAAGCUUGCACCACGG | 64 |
| 29 | UGGUGCAAGCUUGGGUGUCAGCAGCCGAAAGGCUGC | 65 | UGACACCCAAGCUUGCACCAGG | 66 |
| 30 | GGUGCAAGCUUGGGUGUCAAGCAGCCGAAAGGCUGC | 67 | UUGACACCCAAGCUUGCACCGG | 68 |
| 31 | GUGCAAGCUUGGGUGUCAUAGCAGCCGAAAGGCUGC | 69 | UAUGACACCCAAGCUUGCACGG | 70 |
| 32 | GCAAGCUUGGGUGUCAUCUAGCAGCCGAAAGGCUGC | 71 | UAGAUGACACCCAAGCUUGCGG | 72 |
| 33 | CAAGCUUGGGUGUCAUCUCAGCAGCCGAAAGGCUGC | 73 | UGAGAUGACACCCAAGCUUGGG | 74 |
| 34 | AAGCUUGGGUGUCAUCUCAAGCAGCCGAAAGGCUGC | 75 | UUGAGAUGACACCCAAGCUUGG | 76 |
| 35 | AGCUUGGGUGUCAUCUCAGAGCAGCCGAAAGGCUGC | 77 | UCUGAGAUGACACCCAAGCUGG | 78 |
| 36 | GCUUGGGUGUCAUCUCAGAAGCAGCCGAAAGGCUGC | 79 | UUCUGAGAUGACACCCAAGCGG | 80 |
| 37 | GUGUCUCCUUUUGGGACCUAGCAGCCGAAAGGCUGC | 81 | UAGGUCCCAAAAGGAGACACGG | 82 |
| 38 | UGUCUCCUUUUGGGACCUAAGCAGCCGAAAGGCUGC | 83 | UUAGGUCCCAAAAGGAGACAGG | 84 |
| 39 | GGGGACCUGUUACAGACAGAGCAGCCGAAAGGCUGC | 85 | UCUGUCUGUAACAGGUCCCCGG | 86 |
| 40 | GGGACCUGUUACAGACAGUAGCAGCCGAAAGGCUGC | 87 | UACUGUCUGUAACAGGUCCCGG | 88 |
| 41 | GGACCUGUUACAGACAGUCAGCAGCCGAAAGGCUGC | 89 | UGACUGUCUGUAACAGGUCCGG | 90 |
| 42 | GACCUGUUACAGACAGUCUAGCAGCCGAAAGGCUGC | 91 | UAGACUGUCUGUAACAGGUCGG | 92 |
| 43 | ACCUGUUACAGACAGUCUAAGCAGCCGAAAGGCUGC | 93 | UUAGACUGUCUGUAACAGGUGG | 94 |
| 44 | UGCCAUUGUCUGCAACUUUAGCAGCCGAAAGGCUGC | 95 | UAAAGUUGCAGACAAUGGCAGG | 96 |
| 45 | GCCAUUGUCUGCAACUUUGAGCAGCCGAAAGGCUGC | 97 | UCAAAGUUGCAGACAAUGGCGG | 98 |
| 46 | CCAUUGUCUGCAACUUUGGAGCAGCCGAAAGGCUGC | 99 | UCCAAAGUUGCAGACAAUGGGG | 100 |
| 47 | AUUGUCUGCAACUUUGGCAAGCAGCCGAAAGGCUGC | 101 | UUGCCAAAGUUGCAGACAAUGG | 102 |
| 48 | UCUGCAACUUUGGCAGUGAAGCAGCCGAAAGGCUGC | 103 | UUCACUGCCAAAGUUGCAGAGG | 104 |

-continued

SEQ ID NOS: 9-392 - GalXC™-SCAP Oligonucleotides (unmodified)

| GalXC-SCAP Oligo | Sense Strand (passenger; 36-mer) | SEQ ID NO: | Antisense Strand (guide; 22-mer) | SEQ ID NO: |
|---|---|---|---|---|
| 49 | CUACCCACUGCUGAAACUCAGCAGCCGAAAGGCUGC | 105 | UGAGUUUCAGCAGUGGGUAGGG | 106 |
| 50 | GCCAGGAACAGGACCUGUGAGCAGCCGAAAGGCUGC | 107 | UCACAGGUCCUGUUCCUGGCGG | 108 |
| 51 | GAACAGGACCUGUGGAAUUAGCAGCCGAAAGGCUGC | 109 | UAAUUCCACAGGUCCUGUUCGG | 110 |
| 52 | ACAGGACCUGUGGAAUUCAAGCAGCCGAAAGGCUGC | 111 | UUGAAUUCCACAGGUCCUGUGG | 112 |
| 53 | UGGAAUUCACCACCCCUGUAGCAGCCGAAAGGCUGC | 113 | UACAGGGGUGGUGAAUUCCAGG | 114 |
| 54 | CUUGUGACCACCUACAUCAAGCAGCCGAAAGGCUGC | 115 | UUGAUGUAGGUGGUCACAAGGG | 116 |
| 55 | UUGUGACCACCUACAUCAUAGCAGCCGAAAGGCUGC | 117 | UAUGAUGUAGGUGGUCACAAGG | 118 |
| 56 | UGUGACCACCUACAUCAUCAGCAGCCGAAAGGCUGC | 119 | UGAUGAUGUAGGUGGUCACAGG | 120 |
| 57 | GUGACCACCUACAUCAUCUAGCAGCCGAAAGGCUGC | 121 | UAGAUGAUGUAGGUGGUCACGG | 122 |
| 58 | UGACCACCUACAUCAUCUUAGCAGCCGAAAGGCUGC | 123 | UAAGAUGAUGUAGGUGGUCAGG | 124 |
| 59 | GACCACCUACAUCAUCUUGAGCAGCCGAAAGGCUGC | 125 | UCAAGAUGAUGUAGGUGGUCGG | 126 |
| 60 | ACCACCUACAUCAUCUUGUAGCAGCCGAAAGGCUGC | 127 | UACAAGAUGAUGUAGGUGGUGG | 128 |
| 61 | CCACCUACAUCAUCUUGUUAGCAGCCGAAAGGCUGC | 129 | UAACAAGAUGAUGUAGGUGGGG | 130 |
| 62 | CACCUACAUCAUCUUGUUUAGCAGCCGAAAGGCUGC | 131 | UAAACAAGAUGAUGUAGGUGGG | 132 |
| 63 | ACCUACAUCAUCUUGUUUGAGCAGCCGAAAGGCUGC | 133 | UCAAACAAGAUGAUGUAGGUGG | 134 |
| 64 | CCUACAUCAUCUUGUUUGCAGCAGCCGAAAGGCUGC | 135 | UGCAAACAAGAUGAUGUAGGGG | 136 |
| 65 | CUACAUCAUCUUGUUUGCCAGCAGCCGAAAGGCUGC | 137 | UGGCAAACAAGAUGAUGUAGGG | 138 |
| 66 | ACAUCAUCUUGUUUGCCUAAGCAGCCGAAAGGCUGC | 139 | UUAGGCAAACAAGAUGAUGUGG | 140 |
| 67 | AUCAUCUUGUUUGCCUACAAGCAGCCGAAAGGCUGC | 141 | UUGUAGGCAAACAAGAUGAUGG | 142 |
| 68 | UCAUCUUGUUUGCCUACAUAGCAGCCGAAAGGCUGC | 143 | UAUGUAGGCAAACAAGAUGAGG | 144 |
| 69 | AUCUUGUUUGCCUACAUCUAGCAGCCGAAAGGCUGC | 145 | UAGAUGUAGGCAAACAAGAUGG | 146 |
| 70 | UCUUGUUUGCCUACAUCUAAGCAGCCGAAAGGCUGC | 147 | UUAGAUGUAGGCAAACAAGAGG | 148 |
| 71 | UUUCCCCUACCUUGUGGUGAGCAGCCGAAAGGCUGC | 149 | UCACCACAAGGUAGGGGAAAGG | 150 |
| 72 | UUCCCCUACCUUGUGGUGGAGCAGCCGAAAGGCUGC | 151 | UCCACCACAAGGUAGGGGAAGG | 152 |
| 73 | CCCUACCUUGUGGUGGUUAAGCAGCCGAAAGGCUGC | 153 | UUAACCACCACAAGGUAGGGGG | 154 |
| 74 | CUACCUUGUGGUGGUUAUUAGCAGCCGAAAGGCUGC | 155 | UAAUAACCACCACAAGGUAGGG | 156 |
| 75 | UACCUUGUGGUGGUUAUUGAGCAGCCGAAAGGCUGC | 157 | UCAAUAACCACCACAAGGUAGG | 158 |
| 76 | ACCUUGUGGUGGUUAUUGGAGCAGCCGAAAGGCUGC | 159 | UCCAAUAACCACCACAAGGUGG | 160 |
| 77 | CCUUGUGGUGGUUAUUGGGAGCAGCCGAAAGGCUGC | 161 | UCCCAAUAACCACCACAAGGGG | 162 |
| 78 | CUUGUGGUGGUUAUUGGGUAGCAGCCGAAAGGCUGC | 163 | UACCCAAUAACCACCACAAGGG | 164 |
| 79 | UUGUGGUGGUUAUUGGGUUAGCAGCCGAAAGGCUGC | 165 | UAACCCAAUAACCACCACAAGG | 166 |
| 80 | UGUGGUGGUUAUUGGGUUAAGCAGCCGAAAGGCUGC | 167 | UUAACCCAAUAACCACCACAGG | 168 |
| 81 | GUGGUGGUUAUUGGGUUAGAGCAGCCGAAAGGCUGC | 169 | UCUAACCCAAUAACCACCACGG | 170 |
| 82 | UGGUGGUUAUUGGGUUAGAAGCAGCCGAAAGGCUGC | 171 | UUCUAACCCAAUAACCACCAGG | 172 |
| 83 | GGUGGUUAUUGGGUUAGAGAGCAGCCGAAAGGCUGC | 173 | UCUCUAACCCAAUAACCACCGG | 174 |
| 84 | GUGGUUAUUGGGUUAGAGAAGCAGCCGAAAGGCUGC | 175 | UUCUCUAACCCAAUAACCACGG | 176 |

-continued

SEQ ID NOS: 9-392 - GalXC™-SCAP Oligonucleotides (unmodified)

| GalXC-SCAP Oligo | Sense Strand (passenger; 36-mer) | SEQ ID NO: | Antisense Strand (guide; 22-mer) | SEQ ID NO: |
|---|---|---|---|---|
| 85 | UGGUUAUUGGGUUAGAGAAAGCAGCCGAAAGGCUGC | 177 | UUUCUCUAACCCAAUAACCAGG | 178 |
| 86 | GGUUAUUGGGUUAGAGAAUAGCAGCCGAAAGGCUGC | 179 | UAUUCUCUAACCCAAUAACCGG | 180 |
| 87 | GUUAUUGGGUUAGAGAAUGAGCAGCCGAAAGGCUGC | 181 | UCAUUCUCUAACCCAAUAACGG | 182 |
| 88 | UUAUUGGGUUAGAGAAUGUAGCAGCCGAAAGGCUGC | 183 | UACAUUCUCUAACCCAAUAAGG | 184 |
| 89 | AUUGGGUUAGAGAAUGUGUAGCAGCCGAAAGGCUGC | 185 | UACACAUUCUCUAACCCAAUGG | 186 |
| 90 | UUGGGUUAGAGAAUGUGUUAGCAGCCGAAAGGCUGC | 187 | UAACACAUUCUCUAACCCAAGG | 188 |
| 91 | GGUUAGAGAAUGUGUUGGUAGCAGCCGAAAGGCUGC | 189 | UACCAACACAUUCUCUAACCGG | 190 |
| 92 | GUUAGAGAAUGUGUUGGUGAGCAGCCGAAAGGCUGC | 191 | UCACCAACACAUUCUCUAACGG | 192 |
| 93 | UUAGAGAAUGUGUUGGUGCAGCAGCCGAAAGGCUGC | 193 | UGCACCAACACAUUCUCUAAGG | 194 |
| 94 | UAGAGAAUGUGUUGGUGCUAGCAGCCGAAAGGCUGC | 195 | UAGCACCAACACAUUCUCUAGG | 196 |
| 95 | AGAGAAUGUGUUGGUGCUCAGCAGCCGAAAGGCUGC | 197 | UGAGCACCAACACAUUCUCUGG | 198 |
| 96 | GAGAAUGUGUUGGUGCUCAAGCAGCCGAAAGGCUGC | 199 | UUGAGCACCAACACAUUCUCGG | 200 |
| 97 | AGAAUGUGUUGGUGCUCACAGCAGCCGAAAGGCUGC | 201 | UGUGAGCACCAACACAUUCUGG | 202 |
| 98 | AAUGUGUUGGUGCUCACCAAGCAGCCGAAAGGCUGC | 203 | UUGGUGAGCACCAACACAUUGG | 204 |
| 99 | AUGUGUUGGUGCUCACCAAAGCAGCCGAAAGGCUGC | 205 | UUUGGUGAGCACCAACACAUGG | 206 |
| 100 | UGUGUUGGUGCUCACCAAGAGCAGCCGAAAGGCUGC | 207 | UCUUGGUGAGCACCAACACAGG | 208 |
| 101 | UGGUCCAUCAUGAAGAACAAGCAGCCGAAAGGCUGC | 209 | UUGUUCUUCAUGAUGGACCAGG | 210 |
| 102 | GGUCCAUCAUGAAGAACAUAGCAGCCGAAAGGCUGC | 211 | UAUGUUCUUCAUGAUGGACCGG | 212 |

-continued

SEQ ID NOS: 9-392 - GalXC™-SCAP Oligonucleotides (unmodified)

| GalXC-SCAP Oligo | Sense Strand (passenger; 36-mer) | SEQ ID NO: | Antisense Strand (guide; 22-mer) | SEQ ID NO: |
|---|---|---|---|---|
| 103 | CUGACUUCUUCCUUCAGAUAGCAGCCGAAAGGCUGC | 213 | UAUCUGAAGGAAGAAGUCAGGG | 214 |
| 104 | ACUUCUUCCUUCAGAUGCUAGCAGCCGAAAGGCUGC | 215 | UAGCAUCUGAAGGAAGAAGUGG | 216 |
| 105 | UCCUUCAGAUGCUGUUUUUAGCAGCCGAAAGGCUGC | 217 | UAAAAACAGCAUCUGAAGGAGG | 218 |
| 106 | CCUUCAGAUGCUGUUUUUCAGCAGCCGAAAGGCUGC | 219 | UGAAAAACAGCAUCUGAAGGGG | 220 |
| 107 | CUUCAGAUGCUGUUUUUCAAGCAGCCGAAAGGCUGC | 221 | UUGAAAAACAGCAUCUGAAGGG | 222 |
| 108 | UUCAGAUGCUGUUUUUCACAGCAGCCGAAAGGCUGC | 223 | UGUGAAAAACAGCAUCUGAAGG | 224 |
| 109 | CAGAUGCUGUUUUUCACCAAGCAGCCGAAAGGCUGC | 225 | UUGGUGAAAAACAGCAUCUGGG | 226 |
| 110 | AGAUGCUGUUUUUCACCACAGCAGCCGAAAGGCUGC | 227 | UGUGGUGAAAAACAGCAUCUGG | 228 |
| 111 | GAUGCUGUUUUUCACCACUAGCAGCCGAAAGGCUGC | 229 | UAGUGGUGAAAAACAGCAUCGG | 230 |
| 112 | AUGCUGUUUUUCACCACUGAGCAGCCGAAAGGCUGC | 231 | UCAGUGGUGAAAAACAGCAUGG | 232 |
| 113 | UGCUGUUUUUCACCACUGUAGCAGCCGAAAGGCUGC | 233 | UACAGUGGUGAAAAACAGCAGG | 234 |
| 114 | GCUGUUUUUCACCACUGUCAGCAGCCGAAAGGCUGC | 235 | UGACAGUGGUGAAAAACAGCGG | 236 |
| 115 | UGUUUUUCACCACUGUCCUAGCAGCCGAAAGGCUGC | 237 | UAGGACAGUGGUGAAAAACAGG | 238 |
| 116 | GUUUUUCACCACUGUCCUGAGCAGCCGAAAGGCUGC | 239 | UCAGGACAGUGGUGAAAAACGG | 240 |
| 117 | UUUUUCACCACUGUCCUGUAGCAGCCGAAAGGCUGC | 241 | UACAGGACAGUGGUGAAAAAGG | 242 |
| 118 | UUUUCACCACUGUCCUGUCAGCAGCCGAAAGGCUGC | 243 | UGACAGGACAGUGGUGAAAAGG | 244 |
| 119 | UUCACCACUGUCCUGUCCAAGCAGCCGAAAGGCUGC | 245 | UUGGACAGGACAGUGGUGAAGG | 246 |
| 120 | CACCACUGUCCUGUCCAUUAGCAGCCGAAAGGCUGC | 247 | UAAUGGACAGGACAGUGGUGGG | 248 |

-continued

SEQ ID NOS: 9-392 - GalXC™-SCAP Oligonucleotides (unmodified)

| GalXC-SCAP Oligo | Sense Strand (passenger; 36-mer) | SEQ ID NO: | Antisense Strand (guide; 22-mer) | SEQ ID NO: |
|---|---|---|---|---|
| 121 | ACCACUGUCCUGUCCAUUGAGCAGCCGAAAGGCUGC | 249 | UCAAUGGACAGGACAGUGGUGG | 250 |
| 122 | CCACUGUCCUGUCCAUUGAAGCAGCCGAAAGGCUGC | 251 | UUCAAUGGACAGGACAGUGGGG | 252 |
| 123 | CACUGUCCUGUCCAUUGACAGCAGCCGAAAGGCUGC | 253 | UGUCAAUGGACAGGACAGUGGG | 254 |
| 124 | ACUGUCCUGUCCAUUGACAAGCAGCCGAAAGGCUGC | 255 | UUGUCAAUGGACAGGACAGUGG | 256 |
| 125 | CUAAGCUACCUGAGAACCAAGCAGCCGAAAGGCUGC | 257 | UUGGUUCUCAGGUAGCUUAGGG | 258 |
| 126 | GAGGUCCAGCAGAGGUUGUAGCAGCCGAAAGGCUGC | 259 | UACAACCUCUGCUGGACCUCGG | 260 |
| 127 | GCAGAGGUUGUCCAUGACAAGCAGCCGAAAGGCUGC | 261 | UUGUCAUGGACAACCUCUGCGG | 262 |
| 128 | CAGAGGUUGUCCAUGACAGAGCAGCCGAAAGGCUGC | 263 | UCUGUCAUGGACAACCUCUGGG | 264 |
| 129 | GAGGAUGAGGAACUUUGGAAGCAGCCGAAAGGCUGC | 265 | UUCCAAAGUUCCUCAUCCUCGG | 266 |
| 130 | GAACUUUGGAGGAAAUUGUAGCAGCCGAAAGGCUGC | 267 | UACAAUUUCCUCCAAAGUUCGG | 268 |
| 131 | GACGCUCUUCAGCUAUUACAGCAGCCGAAAGGCUGC | 269 | UGUAAUAGCUGAAGAGCGUCGG | 270 |
| 132 | ACGCUCUUCAGCUAUUACAAGCAGCCGAAAGGCUGC | 271 | UUGUAAUAGCUGAAGAGCGUGG | 272 |
| 133 | CGCUCUUCAGCUAUUACAAAGCAGCCGAAAGGCUGC | 273 | UUUGUAAUAGCUGAAGAGCGGG | 274 |
| 134 | GCUCUUCAGCUAUUACAACAGCAGCCGAAAGGCUGC | 275 | UGUUGUAAUAGCUGAAGAGCGG | 276 |
| 135 | CUCUUCAGCUAUUACAACAAGCAGCCGAAAGGCUGC | 277 | UUGUUGUAAUAGCUGAAGAGGG | 278 |
| 136 | UCUUCAGCUAUUACAACAUAGCAGCCGAAAGGCUGC | 279 | UAUGUUGUAAUAGCUGAAGAGG | 280 |
| 137 | CUUCAGCUAUUACAACAUCAGCAGCCGAAAGGCUGC | 281 | UGAUGUUGUAAUAGCUGAAGGG | 282 |
| 138 | UUCAGCUAUUACAACAUCAAGCAGCCGAAAGGCUGC | 283 | UUGAUGUUGUAAUAGCUGAAGG | 284 |

-continued

SEQ ID NOS: 9-392 - GalXC™-SCAP Oligonucleotides (unmodified)

| GalXC-SCAP Oligo | Sense Strand (passenger; 36-mer) | SEQ ID NO: | Antisense Strand (guide; 22-mer) | SEQ ID NO: |
|---|---|---|---|---|
| 139 | CCAGCCUGACCUCACCUGCAGCAGCCGAAAGGCUGC | 285 | UGCAGGUGAGGUCAGGCUGGGG | 286 |
| 140 | CAGCCUGACCUCACCUGCUAGCAGCCGAAAGGCUGC | 287 | UAGCAGGUGAGGUCAGGCUGGG | 288 |
| 141 | AGCCUGACCUCACCUGCUUAGCAGCCGAAAGGCUGC | 289 | UAAGCAGGUGAGGUCAGGCUGG | 290 |
| 142 | GCCUGACCUCACCUGCUUAAGCAGCCGAAAGGCUGC | 291 | UUAAGCAGGUGAGGUCAGGCGG | 292 |
| 143 | CCUGACCUCACCUGCUUAAAGCAGCCGAAAGGCUGC | 293 | UUUAAGCAGGUGAGGUCAGGGG | 294 |
| 144 | CUGACCUCACCUGCUUAAUAGCAGCCGAAAGGCUGC | 295 | UAUUAAGCAGGUGAGGUCAGGG | 296 |
| 145 | UGACCUCACCUGCUUAAUUAGCAGCCGAAAGGCUGC | 297 | UAAUUAAGCAGGUGAGGUCAGG | 298 |
| 146 | GACCUCACCUGCUUAAUUGAGCAGCCGAAAGGCUGC | 299 | UCAAUUAAGCAGGUGAGGUCGG | 300 |
| 147 | ACCUCACCUGCUUAAUUGAAGCAGCCGAAAGGCUGC | 301 | UUCAAUUAAGCAGGUGAGGUGG | 302 |
| 148 | CCUCACCUGCUUAAUUGACAGCAGCCGAAAGGCUGC | 303 | UGUCAAUUAAGCAGGUGAGGGG | 304 |
| 149 | CUCACCUGCUUAAUUGACAAGCAGCCGAAAGGCUGC | 305 | UUGUCAAUUAAGCAGGUGAGGG | 306 |
| 150 | UCACCUGCUUAAUUGACACAGCAGCCGAAAGGCUGC | 307 | UGUGUCAAUUAAGCAGGUGAGG | 308 |
| 151 | CACCUGCUUAAUUGACACCAGCAGCCGAAAGGCUGC | 309 | UGGUGUCAAUUAAGCAGGUGGG | 310 |
| 152 | ACCUGCUUAAUUGACACCAAGCAGCCGAAAGGCUGC | 311 | UUGGUGUCAAUUAAGCAGGUGG | 312 |
| 153 | CCUGCUUAAUUGACACCAAAGCAGCCGAAAGGCUGC | 313 | UUUGGUGUCAAUUAAGCAGGGG | 314 |
| 154 | CUGCUUAAUUGACACCAACAGCAGCCGAAAGGCUGC | 315 | UGUUGGUGUCAAUUAAGCAGGG | 316 |
| 155 | UGCUUAAUUGACACCAACUAGCAGCCGAAAGGCUGC | 317 | UAGUUGGUGUCAAUUAAGCAGG | 318 |
| 156 | GCUUAAUUGACACCAACUUAGCAGCCGAAAGGCUGC | 319 | UAAGUUGGUGUCAAUUAAGCGG | 320 |

-continued

SEQ ID NOS: 9-392 - GalXC™-SCAP Oligonucleotides (unmodified)

| GalXC-SCAP Oligo | Sense Strand (passenger; 36-mer) | SEQ ID NO: | Antisense Strand (guide; 22-mer) | SEQ ID NO: |
|---|---|---|---|---|
| 157 | CUUAAUUGACACCAACUUUAGCAGCCGAAAGGCUGC | 321 | UAAAGUUGGUGUCAAUUAAGGG | 322 |
| 158 | UUAAUUGACACCAACUUUUAGCAGCCGAAAGGCUGC | 323 | UAAAAGUUGGUGUCAAUUAAGG | 324 |
| 159 | UAAUUGACACCAACUUUUCAGCAGCCGAAAGGCUGC | 325 | UGAAAAGUUGGUGUCAAUUAGG | 326 |
| 160 | AUUGAAGGGGUGCUGUGCUAGCAGCCGAAAGGCUGC | 327 | UAGCACAGCACCCCUUCAAUGG | 328 |
| 161 | CUUGGACAAAAGGAUUGUGAGCAGCCGAAAGGCUGC | 329 | UCACAAUCCUUUUGUCCAAGGG | 330 |
| 162 | UUGGACAAAAGGAUUGUGGAGCAGCCGAAAGGCUGC | 331 | UCCACAAUCCUUUUGUCCAAGG | 332 |
| 163 | UCAACGGUUCCCUUGAUUUAGCAGCCGAAAGGCUGC | 333 | UAAAUCAAGGGAACCGUUGAGG | 334 |
| 164 | CAACGGUUCCCUUGAUUUCAGCAGCCGAAAGGCUGC | 335 | UGAAAUCAAGGGAACCGUUGGG | 336 |
| 165 | AACGGUUCCCUUGAUUUCUAGCAGCCGAAAGGCUGC | 337 | UAGAAAUCAAGGGAACCGUUGG | 338 |
| 166 | ACGGUUCCCUUGAUUUCUUAGCAGCCGAAAGGCUGC | 339 | UAAGAAAUCAAGGGAACCGUGG | 340 |
| 167 | GUACAUUGACCAGACCAUGAGCAGCCGAAAGGCUGC | 341 | UCAUGGUCUGGUCAAUGUACGG | 342 |
| 168 | ACCUGUACCACCUCCUGUGAGCAGCCGAAAGGCUGC | 343 | UCACAGGAGGUGGUACAGGUGG | 344 |
| 169 | CCUGUACCACCUCCUGUGUAGCAGCCGAAAGGCUGC | 345 | UACACAGGAGGUGGUACAGGGG | 346 |
| 170 | GUACCACCUCCUGUGUCAUAGCAGCCGAAAGGCUGC | 347 | UAUGACACAGGAGGUGGUACGG | 348 |
| 171 | GCACAGGCAUCAAGUUCUAAGCAGCCGAAAGGCUGC | 349 | UUAGAACUUGAUGCCUGUGCGG | 350 |
| 172 | ACAGGCAUCAAGUUCUACUAGCAGCCGAAAGGCUGC | 351 | UAGUAGAACUUGAUGCCUGUGG | 352 |
| 173 | CAGGCAUCAAGUUCUACUCAGCAGCCGAAAGGCUGC | 353 | UGAGUAGAACUUGAUGCCUGGG | 354 |
| 174 | AGGCAUCAAGUUCUACUCCAGCAGCCGAAAGGCUGC | 355 | UGGAGUAGAACUUGAUGCCUGG | 356 |
| 175 | GGCAUCAAGUUCUACUCCAAGCAGCCGAAAGGCUGC | 357 | UUGGAGUAGAACUUGAUGCCGG | 358 |
| 176 | GCAUCAAGUUCUACUCCAUAGCAGCCGAAAGGCUGC | 359 | UAUGGAGUAGAACUUGAUGCGG | 360 |
| 177 | CAUCAAGUUCUACUCCAUUAGCAGCCGAAAGGCUGC | 361 | UAAUGGAGUAGAACUUGAUGGG | 362 |
| 178 | AUCAAGUUCUACUCCAUUCAGCAGCCGAAAGGCUGC | 363 | UGAAUGGAGUAGAACUUGAUGG | 364 |
| 179 | UCAAGUUCUACUCCAUUCAAGCAGCCGAAAGGCUGC | 365 | UUGAAUGGAGUAGAACUUGAGG | 366 |
| 180 | CAAGUUCUACUCCAUUCAGAGCAGCCGAAAGGCUGC | 367 | UCUGAAUGGAGUAGAACUUGGG | 368 |
| 181 | AAGUUCUACUCCAUUCAGCAGCAGCCGAAAGGCUGC | 369 | UGCUGAAUGGAGUAGAACUUGG | 370 |
| 182 | AGUUCUACUCCAUUCAGCAAGCAGCCGAAAGGCUGC | 371 | UUGCUGAAUGGAGUAGAACUGG | 372 |
| 183 | GUUCUACUCCAUUCAGCAGAGCAGCCGAAAGGCUGC | 373 | UCUGCUGAAUGGAGUAGAACGG | 374 |
| 184 | GUGUCAUCUCAGACAACCUAGCAGCCGAAAGGCUGC | 375 | UAGGUUGUCUGAGAUGACACGG | 376 |
| 185 | CAUCUCAGACAACCUGCUGAGCAGCCGAAAGGCUGC | 377 | UCAGCAGGUUGUCUGAGAUGGG | 378 |
| 186 | UCAGACAACCUGCUGGUGAAGCAGCCGAAAGGCUGC | 379 | UUCACCAGCAGGUUGUCUGAGG | 380 |
| 187 | CGGGGACCUGUUACAGACAAGCAGCCGAAAGGCUGC | 381 | UUGUCUGUAACAGGUCCCCGGG | 382 |
| 188 | GACAACGCUGCCAUUGUCUAGCAGCCGAAAGGCUGC | 383 | UAGACAAUGGCAGCGUUGUCGG | 384 |
| 189 | GCUGCCUCCUGACUGUAAUAGCAGCCGAAAGGCUGC | 385 | UAUUACAGUCAGGAGGCAGCGG | 386 |
| 190 | CUGCCUCCUGACUGUAAUAAGCAGCCGAAAGGCUGC | 387 | UUAUUACAGUCAGGAGGCAGGG | 388 |
| 191 | UAAUAUUAAACUUUUUUAAAGCAGCCGAAAGGCUGC | 389 | UUUAAAAAAGUUUAAUAUUAGG | 390 |
| 192 | AAUAUUAAACUUUUUUAAAAGCAGCCGAAAGGCUGC | 391 | UUUUAAAAAAGUUUAAUAUUGG | 392 |

-continued

| SEQ ID NOS: 9-392 - GalXC™-SCAP Oligonucleotides (unmodified) | | | | |
|---|---|---|---|---|
| GalXC-SCAP Oligo | Sense Strand (passenger; 36-mer) | SEQ ID NO: | Antisense Strand (guide; 22-mer) | SEQ ID NO: |

| SEQ ID NOs: 393-776 - GalXC ™-SCAP Oligonucleotides (modified) | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 1 | mU*mGmUmUmUmGmC/i2FC//i2FU//i2FA//i2FC/mAmUmCmUmAmCmUmUmAmGmCmAmGmCmCmG[ademA-GalNAc][ademA-GalNAc][ademA-GalNAc]mGmGmGmCmUmGmC | 393 | [MePhosphonate-4O-mUs]/i2FA/*/i2FA/*/i2FG//i2FU/mA/i2FG/mAmU/i2FG/mUmAmG/i2FG/mCmAmAmAmCmA*mG*mG | 394 |
| 2 | mG*mUmUmUmGmCmC/i2FU//i2FA//i2FC//i2FA/mUmCmUmAmCmUmUmCmAmGmCmAmGmCmCmG[ademA-GalNAc][ademA-GalNAc][ademA-GalNAc]mGmGmGmCmUmGmC | 395 | [MePhosphonate-4O-mUs]/i2FG/*/i2FA/*/i2FA//i2FG/mU/i2FA/mGmA/i2FU/mGmUmA/i2FG/mGmCmAmAmAmC*mG*mG | 396 |
| 3 | mU*mUmUmGmCmCmU/i2FA//i2FC//i2FA//i2FU/mCmUmAmCmUmUmCmUmAmGmCmAmGmCmCmG[ademA-GalNAc][ademA-GalNAc][ademA-GalNAc]mGmGmGmCmUmGmC | 397 | [MePhosphonate-4O-mUs]/i2FA/*/i2FG/*/i2FA//i2FA/mG/i2FU/mAmG/i2FA/mUmGmU/i2FA/mGmGmCmAmAmA*mG*mG | 398 |
| 4 | mG*mCmCmUmAmCmA/i2FU//i2FC//i2FU//i2FA/mCmUmUmCmUmCmCmAmAmGmCmAmGmCmCmG[ademA-GalNAc][ademA-GalNAc][ademA-GalNAc]mGmGmGmCmUmGmC | 399 | [MePhosphonate-4O-mUs]/i2FU/*/i2FG/*/i2FG//i2FA/mG/i2FA/mAmG/i2FU/mAmGmA/i2FU/mGmUmAmGmGmC*mG*mG | 400 |
| 5 | mA*mAmGmAmUmCmG/i2FA//i2FC//i2FA//i2FU/mGmGmUmCmAmAmGmUmAmGmCmAmGmCmCmG[ademA-GalNAc][ademA-GalNAc][ademA-GalNAc]mGmGmGmCmUmGmC | 401 | [MePhosphonate-4O-mUs]/i2FA/*/i2FC/*/i2FU//i2FU/mG/i2FA/mCmC/i2FA/mUmGmU/i2FC/mGmAmUmCmUmU*mG*mG | 402 |
| 6 | mA*mGmAmUmCmGmA/i2FC//i2FA//i2FU//i2FG/mGmUmCmAmAmGmUmCmAmGmCmAmGmCmCmG[ademA-GalNAc][ademA-GalNAc][ademA-GalNAc]mGmGmGmCmUmGmC | 403 | [MePhosphonate-4O-mUs]/i2FG/*/i2FA/*/i2FC//i2FU/mU/i2FG/mAmC/i2FC/mAmUmG/i2FU/mCmGmAmUmCmU*mG*mG | 404 |
| 7 | mA*mUmCmGmAmCmA/i2FU//i2FG//i2FG//i2FU/mCmAmAmGmUmCmCmAmAmGmCmAmGmCmCmG[ademA-GalNAc][ademA-GalNAc][ademA-GalNAc]mGmGmGmCmUmGmC | 405 | [MePhosphonate-4O-mUs]/i2FU/*/i2FG/*/i2FG//i2FA/mC/i2FU/mUmG/i2FA/mCmCmA/i2FU/mGmUmCmGmAmU*mG*mG | 406 |
| 8 | mG*mUmGmUmUmGmG/i2FU//i2FG//i2FC//i2FU/mCmAmCmCmAmAmGmUmAmGmCmAmGmCmCmG[ademA-GalNAc][ademA-GalNAc][ademA-GalNAc]mGmGmGmCmUmGmC | 407 | [MePhosphonate-4O-mUs]/i2FA/*/i2FC/*/i2FU//i2FU/mG/i2FG/mUmG/i2FA/mGmCmA/i2FC/mCmAmAmCmAmC*mG*mG | 408 |
| 9 | mU*mGmUmUmGmGmU/i2FG//i2FC//i2FU//i2FC/mAmCmCmAmAmGmUmCmAmGmCmAmGmCmCmG[ademA-GalNAc][ademA-GalNAc][ademA-GalNAc]mGmGmGmCmUmGmC | 409 | [MePhosphonate-4O-mUs]/i2FG/*/i2FA/*/i2FC//i2FU/mU/i2FG/mGmU/i2FG/mAmGmC/i2FA/mCmCmAmAmCmA*mG*mG | 410 |
| 10 | mG*mAmGmAmGmCmU/i2FG//i2FG//i2FU//i2FC/mCmAmUmCmAmUmGmAmAmGmCmAmGmCmCmG[ademA-GalNAc][ademA-GalNAc][ademA-GalNAc]mGmGmGmCmUmGmC | 411 | [MePhosphonate-4O-mUs]/i2FU/*/i2FC/*/i2FA//i2FU/mG/i2FA/mUmG/i2FG/mAmCmC/i2FA/mGmCmUmCmUmC*mG*mG | 412 |

-continued

| SEQ ID NOs: 393-776 - GalXC ™-SCAP Oligonucleotides (modified) | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 11 | mA*mGmAmGmCmUmG/i2FG//i2FU//i2FC//i2FC/mAmUmCmAmUmGmAmAmAmGmCmAmGmCmCmG[ademA-GalNAc][ademA-GalNAc][ademA-GalNAc]mGmGmCmUmGmC | 413 | [MePhosphonate-4O-mUs]/i2FU/*/i2FU/*/i2FC//i2FA/mU/i2FG/mAmU/i2FG/mGmAmC/i2FC/mAmGmCmUmCmU*mG*mG | 414 |
| 12 | mG*mAmGmCmUmGmG/i2FU//i2FC//i2FC//i2FA/mUmCmAmUmGmAmAmGmAmGmCmAmGmCmCmG[ademA-GalNAc][ademA-GalNAc][ademA-GalNAc]mGmGmCmUmGmC | 415 | [MePhosphonate-4O-mUs]/i2FC/*/i2FU/*/i2FU//i2FC/mA/i2FU/mGmA/i2FU/mGmGmA/i2FC/mCmAmGmCmUmC*mG*mG | 416 |
| 13 | mA*mGmCmUmGmGmU/i2FC//i2FC//i2FA//i2FU/mCmAmUmGmAmAmGmAmAmGmCmAmGmCmCmG[ademA-GalNAc][ademA-GalNAc][ademA-GalNAc]mGmGmCmUmGmC | 417 | [MePhosphonate-4O-mUs]/i2FU/*/i2FC/*/i2FU//i2FU/mC/i2FA/mUmG/i2FA/mUmGmG/i2FA/mCmCmAmGmCmU*mG*mG | 418 |
| 14 | mG*mCmUmGmGmUmC/i2FC//i2FA//i2FU//i2FC/mAmUmGmAmAmGmAmAmAmGmCmAmGmCmCmG[ademA-GalNAc][ademA-GalNAc][ademA-GalNAc]mGmGmCmUmGmC | 419 | [MePhosphonate-4O-mUs]/i2FU/*/i2FU/*/i2FC//i2FU/mU/i2FC/mAmU/i2FG/mAmUmG/i2FG/mAmCmCmAmGmC*mG*mG | 420 |
| 15 | mC*mUmGmGmUmCmC/i2FA//i2FU//i2FC//i2FA/mUmGmAmAmGmAmAmCmAmGmCmAmGmCmCmG[ademA-GalNAc][ademA-GalNAc][ademA-GalNAc]mGmGmCmUmGmC | 421 | [MePhosphonate-4O-mUs]/i2FG/*/i2FU/*/i2FU//i2FC/mU/i2FU/mCmA/i2FU/mGmAmU/i2FG/mGmAmCmCmAmG*mG*mG | 422 |
| 16 | mC*mCmGmUmUmGmU/i2FC//i2FU//i2FG//i2FG/mAmUmUmGmGmCmAmUmAmGmCmAmGmCmCmG[ademA-GalNAc][ademA-GalNAc][ademA-GalNAc]mGmGmCmUmGmC | 423 | [MePhosphonate-4O-mUs]/i2FA/*/i2FU/*/i2FG//i2FC/mC/i2FA/mAmU/i2FC/mCmAmG/i2FA/mCmAmAmCmGmG*mG*mG | 424 |
| 17 | mU*mUmGmUmCmUmG/i2FG//i2FA//i2FU//i2FU/mGmGmCmAmUmCmCmUmAmGmCmAmGmCmCmG[ademA-GalNAc][ademA-GalNAc][ademA-GalNAc]mGmGmCmUmGmC | 425 | [MePhosphonate-4O-mUs]/i2FA/*/i2FG/*/i2FG//i2FA/mU/i2FG/mCmC/i2FA/mAmUmC/i2FC/mAmGmAmCmAmA*mG*mG | 426 |
| 18 | mU*mGmUmCmUmGmG/i2FA//i2FU//i2FU//i2FG/mGmCmAmUmCmCmUmGmAmGmCmAmGmCmCmG[ademA-GalNAc][ademA-GalNAc][ademA-GalNAc]mGmGmCmUmGmC | 427 | [MePhosphonate-4O-mUs]/i2FC/*/i2FA/*/i2FG//i2FG/mA/i2FU/mGmC/i2FC/mAmAmU/i2FC/mCmAmGmAmCmA*mG*mG | 428 |
| 19 | mG*mUmCmUmGmGmA/i2FU//i2FU//i2FG//i2FG/mCmAmUmCmCmUmGmGmAmGmCmAmGmCmCmG[ademA-GalNAc][ademA-GalNAc][ademA-GalNAc]mGmGmCmUmGmC | 429 | [MePhosphonate-4O-mUs]/i2FC/*/i2FC/*/i2FA//i2FG/mG/i2FA/mUmG/i2FC/mCmAmA/i2FU/mCmCmAmGmAmC*mG*mG | 430 |
| 20 | mC*mUmGmGmAmUmU/i2FG//i2FG//i2FC//i2FA/mUmCmCmUmGmGmUmAmAmGmCmAmGmCmCmG[ademA-GalNAc][ademA-GalNAc][ademA-GalNAc]mGmGmCmUmGmC | 431 | [MePhosphonate-4O-mUs]/i2FU/*/i2FA/*/i2FC//i2FC/mA/i2FG/mGmA/i2FU/mGmCmC/i2FA/mAmUmCmCmAmG*mG*mG | 432 |
| 21 | mU*mGmGmAmUmUmG/i2FG//i2FC//i2FA//i2FU/mCmCmUmGmGmUmAmUmAmGmCmAmGmCmCmG[ademA-GalNAc][ademA-GalNAc][ademA-GalNAc]mGmGmCmUmGmC | 433 | [MePhosphonate-4O-mUs]/i2FA/*/i2FU/*/i2FA//i2FC/mC/i2FA/mGmG/i2FA/mUmGmC/i2FC/mAmAmUmCmCmA*mG*mG | 434 |
| 22 | mG*mGmAmUmUmGmG/i2FC//i2FA//i2FU//i2FC/mCmUmGmGmUmAmUmAmAmGmCmAmGmCmCmG[ademA-GalNAc][ademA-GalNAc][ademA-GalNAc]mGmGmCmUmGmC | 435 | [MePhosphonate-4O-mUs]/i2FU/*/i2FA/*/i2FU//i2FA/mC/i2FC/mAmG/i2FG/mAmUmG/i2FC/mCmAmAmUmCmC*mG*mG | 436 |

-continued

SEQ ID NOs: 393-776 - GalXC ™-SCAP Oligonucleotides (modified)

| GalXC-SCAP Oligo | Sense Strand (passenger; 36-mer) | SEQ ID NO: | Antisense Strand (guide; 22-mer) | SEQ ID NO: |
|---|---|---|---|---|
| 23 | mG*mAmUmUmGmGmC/i2FA//i2FU//i2FC//i2FC/mUmGmGmUmAmUmAmCmAmGmCmAmGmCmCmG[ademA-GalNAc][ademA-GalNAc][ademA-GalNAc]mGmGmCmUmGmC | 437 | [MePhosphonate-4O-mUs]/i2FG/*/i2FU/*/i2FA//i2FU/mA/i2FC/mCmA/i2FG/mGmAmU/i2FG/mCmCmAmAmUmC*mG*mG | 438 |
| 24 | mA*mUmUmGmGmCmA/i2FU//i2FC//i2FC//i2FU/mGmGmUmAmUmAmCmAmAmGmCmAmGmCmCmG[ademA-GalNAc][ademA-GalNAc][ademA-GalNAc]mGmGmCmUmGmC | 439 | [MePhosphonate-4O-mUs]/i2FU/*/i2FG/*/i2FU//i2FA/mU/i2FA/mCmC/i2FA/mGmGmA/i2FU/mGmCmCmAmAmU*mG*mG | 440 |
| 25 | mC*mUmCmCmAmUmC/i2FU//i2FU//i2FC//i2FC/mCmAmCmCmUmGmAmUmAmGmCmAmGmCmCmG[ademA-GalNAc][ademA-GalNAc][ademA-GalNAc]mGmGmCmUmGmC | 441 | [MePhosphonate-4O-mUs]/i2FA/*/i2FU/*/i2FC//i2FA/mG/i2FG/mUmG/i2FG/mGmAmA/i2FG/mAmUmGmGmAmG*mG*mG | 442 |
| 26 | mC*mAmUmCmUmGmC/i2FC//i2FU//i2FG//i2FU/mGmGmGmAmUmGmUmAmAmGmCmAmGmCmCmG[ademA-GalNAc][ademA-GalNAc][ademA-GalNAc]mGmGmCmUmGmC | 443 | [MePhosphonate-4O-mUs]/i2FU/*/i2FA/*/i2FC//i2FA/mU/i2FC/mCmC/i2FA/mCmAmG/i2FG/mCmAmGmAmUmG*mG*mG | 444 |
| 27 | mU*mCmUmGmCmCmU/i2FG//i2FU//i2FG//i2FG/mGmAmUmGmUmAmCmUmAmGmCmAmGmCmCmG[ademA-GalNAc][ademA-GalNAc][ademA-GalNAc]mGmGmCmUmGmC | 445 | [MePhosphonate-4O-mUs]/i2FA/*/i2FG/*/i2FU//i2FA/mC/i2FA/mUmC/i2FC/mCmAmC/i2FA/mGmGmCmAmGmA*mG*mG | 446 |
| 28 | mG*mUmGmGmUmGmC/i2FA//i2FA//i2FG//i2FC/mUmUmGmGmGmUmGmUmAmGmCmAmGmCmCmG[ademA-GalNAc][ademA-GalNAc][ademA-GalNAc]mGmGmCmUmGmC | 447 | [MePhosphonate-4O-mUs]/i2FA/*/i2FC/*/i2FA//i2FC/mC/i2FC/mAmA/i2FG/mCmUmU/i2FG/mCmAmCmCmAmC*mG*mG | 448 |
| 29 | mU*mGmGmUmGmCmA/i2FA//i2FG//i2FC//i2FU/mUmGmGmGmUmGmUmCmAmGmCmAmGmCmCmG[ademA-GalNAc][ademA-GalNAc][ademA-GalNAc]mGmGmCmUmGmC | 449 | [MePhosphonate-4O-mUs]/i2FG/*/i2FA/*/i2FC//i2FA/mC/i2FC/mCmA/i2FA/mGmCmU/i2FU/mGmCmAmCmCmA*mG*mG | 450 |
| 30 | mG*mGmUmGmCmAmA/i2FG//i2FC//i2FU//i2FU/mGmGmGmUmGmUmCmAmAmGmCmAmGmCmCmG[ademA-GalNAc][ademA-GalNAc][ademA-GalNAc]mGmGmCmUmGmC | 451 | [MePhosphonate-4O-mUs]/i2FU/*/i2FG/*/i2FA//i2FC/mA/i2FC/mCmC/i2FA/mAmGmC/i2FU/mUmGmCmAmCmC*mG*mG | 452 |
| 31 | mG*mUmGmCmAmAmG/i2FC//i2FU//i2FU//i2FG/mGmGmUmGmUmCmAmUmAmGmCmAmGmCmCmG[ademA-GalNAc][ademA-GalNAc][ademA-GalNAc]mGmGmCmUmGmC | 453 | [MePhosphonate-4O-mUs]/i2FA/*/i2FU/*/i2FG//i2FA/mC/i2FA/mCmC/i2FC/mAmAmG/i2FC/mUmUmGmCmAmC*mG*mG | 454 |
| 32 | mG*mCmAmAmGmCmU/i2FU//i2FG//i2FG//i2FG/mUmGmUmCmAmUmCmUmAmGmCmAmGmCmCmG[ademA-GalNAc][ademA-GalNAc][ademA-GalNAc]mGmGmCmUmGmC | 455 | [MePhosphonate-4O-mUs]/i2FA/*/i2FG/*/i2FA//i2FU/mG/i2FA/mCmA/i2FC/mCmCmA/i2FA/mGmCmUmUmGmC*mG*mG | 456 |
| 33 | mC*mAmAmGmCmUmU/i2FG//i2FG//i2FG//i2FU/mGmUmCmAmUmCmUmCmAmGmCmAmGmCmCmG[ademA-GalNAc][ademA-GalNAc][ademA-GalNAc]mGmGmCmUmGmC | 457 | [MePhosphonate-4O-mUs]/i2FG/*/i2FA/*/i2FG//i2FA/mU/i2FG/mAmC/i2FA/mCmCmC/i2FA/mAmGmCmUmUmG*mG*mG | 458 |
| 34 | mA*mAmGmCmUmUmG/i2FG//i2FG//i2FU//i2FG/mUmCmAmUmCmUmCmAmAmGmCmAmGmCmCmG[ademA-GalNAc][ademA-GalNAc][ademA-GalNAc]mGmGmCmUmGmC | 459 | [MePhosphonate-4O-mUs]/i2FU/*/i2FG/*/i2FA//i2FG/mA/i2FU/mGmA/i2FC/mAmCmC/i2FC/mAmAmGmCmUmU*mG*mG | 460 |

-continued

SEQ ID NOs: 393-776 - GalXC™-SCAP Oligonucleotides (modified)

| GalXC-SCAP Oligo | Sense Strand (passenger; 36-mer) | SEQ ID NO: | Antisense Strand (guide; 22-mer) | SEQ ID NO: |
|---|---|---|---|---|
| 35 | mA*mGmGmCmUmUmGmG/i2FG//i2FU//i2FG//i2FU/mCmAmUmCmUmCmAmGmAmGmCmAmGmCmCmG[ademA-GalNAc][ademA-GalNAc][ademA-GalNAc]mGmGmCmUmGmC | 461 | [MePhosphonate-4O-mUs]/i2FC/*/i2FU/*/i2FG//i2FA/mG/i2FA/mUmG/i2FA/mCmAmC/i2FC/mCmAmAmGmCmU*mG*mG | 462 |
| 36 | mG*mCmUmUmGmGmG/i2FU//i2FG//i2FU//i2FC/mAmUmCmUmCmAmGmAmAmGmCmAmGmCmCmG[ademA-GalNAc][ademA-GalNAc][ademA-GalNAc]mGmGmCmUmGmC | 463 | [MePhosphonate-4O-mUs]/i2FU/*/i2FC/*/i2FU//i2FG/mA/i2FG/mAmU/i2FG/mAmCmA/i2FC/mCmCmAmAmGmC*mG*mG | 464 |
| 37 | mG*mUmGmUmCmUmC/i2FC//i2FU//i2FU//i2FU/mUmGmGmGmAmCmCmUmAmGmCmAmGmCmCmG[ademA-GalNAc][ademA-GalNAc][ademA-GalNAc]mGmGmCmUmGmC | 465 | [MePhosphonate-4O-mUs]/i2FA/*/i2FG/*/i2FG//i2FU/mC/i2FC/mCmA/i2FA/mAmAmG/i2FG/mAmGmAmCmAmC*mG*mG | 466 |
| 38 | mU*mGmUmCmUmCmC/i2FU//i2FU//i2FU//i2FU/mGmGmGmAmCmCmUmAmAmGmCmAmGmCmCmG[ademA-GalNAc][ademA-GalNAc][ademA-GalNAc]mGmGmCmUmGmC | 467 | [MePhosphonate-4O-mUs]/i2FU/*/i2FA/*/i2FG//i2FG/mU/i2FC/mCmC/i2FA/mAmAmA/i2FG/mGmAmGmAmCmA*mG*mG | 468 |
| 39 | mG*mGmGmGmAmCmC/i2FU//i2FG//i2FU//i2FU/mAmCmAmGmAmCmAmGmAmGmCmAmGmCmCmG[ademA-GalNAc][ademA-GalNAc][ademA-GalNAc]mGmGmCmUmGmC | 469 | [MePhosphonate-4O-mUs]/i2FC/*/i2FU/*/i2FG//i2FU/mC/i2FU/mGmU/i2FA/mAmCmA/i2FG/mGmUmCmCmCmC*mG*mG | 470 |
| 40 | mG*mGmGmAmCmCmU/i2FG//i2FU//i2FU//i2FA/mCmAmGmAmCmAmGmUmAmGmCmAmGmCmCmG[ademA-GalNAc][ademA-GalNAc][ademA-GalNAc]mGmGmCmUmGmC | 471 | [MePhosphonate-4O-mUs]/i2FA/*/i2FC/*/i2FU//i2FG/mU/i2FC/mUmG/i2FU/mAmAmC/i2FA/mGmGmUmCmCmC*mG*mG | 472 |
| 41 | mG*mGmAmCmCmUmG/i2FU//i2FU//i2FA//i2FC/mAmGmAmCmAmGmUmCmAmGmCmAmGmCmCmG[ademA-GalNAc][ademA-GalNAc][ademA-GalNAc]mGmGmCmUmGmC | 473 | [MePhosphonate-4O-mUs]/i2FG/*/i2FA/*/i2FC//i2FU/mG/i2FU/mCmU/i2FG/mUmAmA/i2FC/mAmGmGmUmCmC*mG*mG | 474 |
| 42 | mG*mAmCmCmUmGmU/i2FU//i2FA//i2FC//i2FA/mGmAmCmAmGmUmCmUmAmGmCmAmGmCmCmG[ademA-GalNAc][ademA-GalNAc][ademA-GalNAc]mGmGmCmUmGmC | 475 | [MePhosphonate-4O-mUs]/i2FA/*/i2FG/*/i2FA//i2FC/mU/i2FG/mUmC/i2FU/mGmUmA/i2FA/mCmAmGmGmUmC*mG*mG | 476 |
| 43 | mA*mCmCmUmGmUmU/i2FA//i2FC//i2FA//i2FG/mAmCmAmGmUmCmUmAmAmGmCmAmGmCmCmG[ademA-GalNAc][ademA-GalNAc][ademA-GalNAc]mGmGmCmUmGmC | 477 | [MePhosphonate-4O-mUs]/i2FU/*/i2FA/*/i2FG//i2FA/mC/i2FU/mGmU/i2FC/mUmGmU/i2FA/mAmCmAmGmGmU*mG*mG | 478 |
| 44 | mU*mGmCmCmAmUmU/i2FG//i2FU//i2FC//i2FU/mGmCmAmAmCmUmUmUmAmGmCmAmGmCmCmG[ademA-GalNAc][ademA-GalNAc][ademA-GalNAc]mGmGmCmUmGmC | 479 | [MePhosphonate-4O-mUs]/i2FA/*/i2FA/*/i2FA//i2FG/mU/i2FU/mGmC/i2FA/mGmAmC/i2FA/mAmUmGmGmCmA*mG*mG | 480 |
| 45 | mG*mCmCmAmUmUmG/i2FU//i2FC//i2FU//i2FG/mCmAmAmCmUmUmUmGmAmGmCmAmGmCmCmG[ademA-GalNAc][ademA-GalNAc][ademA-GalNAc]mGmGmCmUmGmC | 481 | [MePhosphonate-4O-mUs]/i2FC/*/i2FA/*/i2FA//i2FA/mG/i2FU/mUmG/i2FC/mAmGmA/i2FC/mAmAmUmGmGmC*mG*mG | 482 |
| 46 | mC*mCmAmUmUmGmU/i2FC//i2FU//i2FG//i2FC/mAmAmCmUmUmUmGmGmAmGmCmAmGmCmCmG[ademA-GalNAc][ademA-GalNAc][ademA-GalNAc]mGmGmCmUmGmC | 483 | [MePhosphonate-4O-mUs]/i2FC/*/i2FC/*/i2FA//i2FA/mA/i2FG/mUmU/i2FG/mCmAmG/i2FA/mCmAmAmUmGmG*mG*mG | 484 |

-continued

| SEQ ID NOs: 393-776 - GalXC ™-SCAP Oligonucleotides (modified) | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 47 | mA*mUmUmGmUmCmU/ i2FG//i2FC//i2FA//i2FA/ mCmUmUmUmGmGmCmAmAmGmCmAmGmCmCmG[ademA-GalNAc][ademA-GalNAc][ademA-GalNAc]mGmGmCmUmGmC | 485 | [MePhosphonate-4O-mUs]/i2FU/*/i2FG/*/i2FC//i2FC/ mA/i2FA/mAmG/i2FU/ mUmGmC/i2FA/ mGmAmCmAmAmU*mG*mG | 486 |
| 48 | mU*mCmUmGmCmAmA/ i2FC//i2FU//i2FU//i2FU/ mGmGmCmAmGmUmGmAmAmGmCmAmGmCmCmG[ademA-GalNAc][ademA-GalNAc][ademA-GalNAc]mGmGmCmUmGmC | 487 | [MePhosphonate-4O-mUs]/i2FU/*/i2FC/*/i2FA//i2FC/ mU/i2FG/mCmC/i2FA/ mAmAmG/i2FU/ mUmGmCmAmGmA*mG*mG | 488 |
| 49 | mC*mUmAmCmCmCmA/ i2FC//i2FU//i2FG//i2FC/ mUmGmAmAmAmCmUmCmAmGmCmAmGmCmCmG[ademA-GalNAc][ademA-GalNAc][ademA-GalNAc]mGmGmCmUmGmC | 489 | [MePhosphonate-4O-mUs]/i2FG/*/i2FA/*/i2FG//i2FU/ mU/i2FU/mCmA/i2FG/ mCmAmG/i2FU/ mGmGmGmUmAmG*mG*mG | 490 |
| 50 | mG*mCmCmAmGmG i2FA//i2FC//i2FA//i2FG/ mGmAmCmCmUmGmUmGmAmGmCmAmGmCmCmG[ademA-GalNAc][ademA-GalNAc][ademA-GalNAc]mGmGmCmUmGmC | 491 | [MePhosphonate-4O-mUs]/i2FC/*/i2FA/*/i2FC//i2FA/ mG/i2FG/mUmC/i2FC/ mUmGmU/i2FU/ mCmCmUmGmGmC*mG*mG | 492 |
| 51 | mG*mAmAmCmAmGmG/ i2FA//i2FC//i2FC//i2FU/ mGmUmGmGmAmAmUmUmAmGmCmAmGmCmCmG[ademA-GalNAc][ademA-GalNAc][ademA-GalNAc]mGmGmCmUmGmC | 493 | [MePhosphonate-4O-mUs]/i2FA/*/i2FA/*/i2FU//i2FU/ mC/i2FC/mAmC/i2FA/ mGmGmU/i2FC/ mCmUmGmUmUmC*mG*mG | 494 |
| 52 | mA*mCmAmGmGmAmC/ i2FC//i2FU//i2FG//i2FU/ mGmGmAmAmUmUmCmAmAmGmCmAmGmCmCmG[ademA-GalNAc][ademA-GalNAc][ademA-GalNAc]mGmGmCmUmGmC | 495 | [MePhosphonate-4O-mUs]/i2FU/*/i2FG/*/i2FA//i2FA/ mU/i2FU/mCmC/i2FA/ mCmAmG/i2FG/ mUmCmCmUmGmUmG*mG | 496 |
| 53 | mU*mGmGmAmAmUmU/ i2FC//i2FA//i2FC//i2FC/ mAmCmCmCmCmUmGmUmAmGmCmAmGmCmCmG[ademA-GalNAc][ademA-GalNAc][ademA-GalNAc]mGmGmCmUmGmC | 497 | [MePhosphonate-4O-mUs]/i2FA/*/i2FC/*/i2FA//i2FG/ mG/i2FG/mGmU/i2FG/ mGmUmG/i2FA/ mAmUmUmCmCmA*mG*mG | 498 |
| 54 | mC*mUmUmGmUmGmA/ i2FC//i2FC//i2FA//i2FC/ mCmUmAmCmAmUmCmAmAmGmCmAmGmCmCmG[ademA-GalNAc][ademA-GalNAc][ademA-GalNAc]mGmGmCmUmGmC | 499 | [MePhosphonate-4O-mUs]/i2FU/*/i2FG/*/i2FA//i2FU/ mG/i2FU/mAmG/i2FG/ mUmGmG/i2FU/ mCmAmCmAmAmG*mG*mG | 500 |
| 55 | mU*mUmGmUmGmAmC/ i2FC//i2FA//i2FC//i2FC/ mUmAmCmAmUmCmAmUmAmGmCmAmGmCmCmG[ademA-GalNAc][ademA-GalNAc][ademA-GalNAc]mGmGmCmUmGmC | 501 | [MePhosphonate-4O-mUs]/i2FA/*/i2FU/*/i2FG//i2FA/ mU/i2FG/mUmA/i2FG/ mGmUmG/i2FG/ mUmCmAmCmAmA*mG*mG | 502 |
| 56 | mU*mGmUmGmAmCmC/ i2FA//i2FC//i2FC//i2FU/ mAmCmAmUmCmAmUmCmAmGmCmAmGmCmCmG[ademA-GalNAc][ademA-GalNAc][ademA-GalNAc]mGmGmCmUmGmC | 503 | [MePhosphonate-4O-mUs]/i2FG/*/i2FA/*/i2FU//i2FG/ mA/i2FU/mGmU/i2FA/ mGmGmU/i2FG/ mGmUmCmAmCmA*mG*mG | 504 |
| 57 | mG*mUmGmAmCmCmA/ i2FC//i2FC//i2FU//i2FA/ mCmAmUmCmAmUmCmUmAmGmCmAmGmCmCmG[ademA-GalNAc][ademA-GalNAc][ademA-GalNAc]mGmGmCmUmGmC | 505 | [MePhosphonate-4O-mUs]/i2FA/*/i2FG/*/i2FA//i2FU/ mG/i2FA/mUmG/i2FU/ mAmGmG/i2FU/ mGmGmUmCmAmC*mG*mG | 506 |
| 58 | mU*mGmAmCmCmAmC/ i2FC//i2FU//i2FA//i2FC/ mAmUmCmAmUmCmUmUmAmGmCmAmGmCmCmG[ademA-GalNAc][ademA-GalNAc][ademA-GalNAc]mGmGmCmUmGmC | 507 | [MePhosphonate-4O-mUs]/i2FA/*/i2FA/*/i2FG//i2FA/ mU/i2FG/mAmU/i2FG/ mUmAmG/i2FG/ mUmGmGmUmCmA*mG*mG | 508 |

-continued

| GalXC-SCAP Oligo | Sense Strand (passenger; 36-mer) | SEQ ID NO: | Antisense Strand (guide; 22-mer) | SEQ ID NO: |
|---|---|---|---|---|
| | SEQ ID NOs: 393-776 - GalXC ™-SCAP Oligonucleotides (modified) | | | |
| 59 | mG*mAmCmCmAmCmC/i2FU//i2FA//i2FC//i2FA/mUmCmAmUmCmUmUmGmAmGmCmAmGmCmCmG[ademA-GalNAc][ademA-GalNAc][ademA-GalNAc]mGmGmCmUmGmC | 509 | [MePhosphonate-4O-mUs]/i2FC/*/i2FA/*/i2FA//i2FG/mA/i2FU/mGmA/i2FU/mGmUmA/i2FG/mGmUmGmGmUmC*mG*mG | 510 |
| 60 | mA*mCmCmAmCmCmU/i2FA//i2FC//i2FA//i2FU/mCmAmUmCmUmUmGmUmAmGmCmAmGmCmCmG[ademA-GalNAc][ademA-GalNAc][ademA-GalNAc]mGmGmCmUmGmC | 511 | [MePhosphonate-4O-mUs]/i2FA/*/i2FC/*/i2FA//i2FA/mG/i2FA/mUmG/i2FA/mUmGmU/i2FA/mGmGmUmGmGmU*mG*mG | 512 |
| 61 | mC*mCmAmCmCmUmA/i2FC//i2FA//i2FU//i2FC/mAmUmCmUmUmGmUmUmAmGmCmAmGmCmCmG[ademA-GalNAc][ademA-GalNAc][ademA-GalNAc]mGmGmCmUmGmC | 513 | [MePhosphonate-4O-mUs]/i2FA/*/i2FA/*/i2FC//i2FA/mA/i2FG/mAmU/i2FG/mAmUmG/i2FU/mAmGmGmUmGmG*mG*mG | 514 |
| 62 | mC*mAmCmCmUmAmC/i2FA//i2FU//i2FC//i2FA/mUmCmUmUmGmUmUmUmAmGmCmAmGmCmCmG[ademA-GalNAc][ademA-GalNAc][ademA-GalNAc]mGmGmCmUmGmC | 515 | [MePhosphonate-4O-mUs]/i2FA/*/i2FA/*/i2FA//i2FC/mA/i2FA/mGmA/i2FU/mGmAmU/i2FG/mUmAmGmGmUmG*mG*mG | 516 |
| 63 | mA*mCmCmUmAmCmA/i2FU//i2FC//i2FA//i2FU/mCmUmUmGmUmUmUmGmAmGmCmAmGmCmCmG[ademA-GalNAc][ademA-GalNAc][ademA-GalNAc]mGmGmCmUmGmC | 517 | [MePhosphonate-4O-mUs]/i2FC/*/i2FA/*/i2FA//i2FA/mC/i2FA/mAmG/i2FA/mUmGmA/i2FU/mGmUmAmGmGmU*mG*mG | 518 |
| 64 | mC*mCmUmAmCmAmU/i2FC//i2FA//i2FU//i2FC/mUmUmGmUmUmUmGmCmAmGmCmAmGmCmCmG[ademA-GalNAc][ademA-GalNAc][ademA-GalNAc]mGmGmCmUmGmC | 519 | [MePhosphonate-4O-mUs]/i2FG/*/i2FC/*/i2FA//i2FA/mA/i2FC/mAmA/i2FG/mAmUmG/i2FA/mUmGmUmAmGmG*mG*mG | 520 |
| 65 | mC*mUmAmCmAmUmC/i2FA//i2FU//i2FC//i2FU/mUmGmUmUmUmGmCmCmAmGmCmAmGmCmCmG[ademA-GalNAc][ademA-GalNAc][ademA-GalNAc]mGmGmCmUmGmC | 521 | [MePhosphonate-4O-mUs]/i2FG/*/i2FG/*/i2FC//i2FA/mA/i2FA/mCmA/i2FA/mGmAmU/i2FG/mAmUmGmUmAmG*mG*mG | 522 |
| 66 | mA*mCmAmUmCmAmU/i2FC//i2FU//i2FU//i2FG/mUmUmUmGmCmCmUmAmAmGmCmAmGmCmCmG[ademA-GalNAc][ademA-GalNAc][ademA-GalNAc]mGmGmCmUmGmC | 523 | [MePhosphonate-4O-mUs]/i2FU/*/i2FA/*/i2FG//i2FG/mC/i2FA/mAmA/i2FC/mAmAmG/i2FA/mUmGmAmUmGmU*mG*mG | 524 |
| 67 | mA*mUmCmAmUmCmU/i2FU//i2FG//i2FU//i2FU/mUmGmCmCmUmAmCmAmAmGmCmAmGmCmCmG[ademA-GalNAc][ademA-GalNAc][ademA-GalNAc]mGmGmCmUmGmC | 525 | [MePhosphonate-4O-mUs]/i2FU/*/i2FG/*/i2FU//i2FA/mG/i2FG/mCmA/i2FA/mAmCmA/i2FA/mGmAmUmGmAmU*mG*mG | 526 |
| 68 | mU*mCmAmUmCmUmU/i2FG//i2FU//i2FU//i2FU/mGmCmCmUmAmCmAmUmAmGmCmAmGmCmCmG[ademA-GalNAc][ademA-GalNAc][ademA-GalNAc]mGmGmCmUmGmC | 527 | [MePhosphonate-4O-mUs]/i2FA/*/i2FU/*/i2FG//i2FU/mA/i2FG/mGmC/i2FA/mAmAmC/i2FA/mAmGmAmUmGmA*mG*mG | 528 |
| 69 | mA*mUmCmUmUmGmU/i2FU//i2FU//i2FG//i2FC/mCmUmAmCmAmUmCmUmAmGmCmAmGmCmCmG[ademA-GalNAc][ademA-GalNAc][ademA-GalNAc]mGmGmCmUmGmC | 529 | [MePhosphonate-4O-mUs]/i2FA/*/i2FG/*/i2FA//i2FU/mG/i2FU/mAmG/i2FG/mCmAmA/i2FA/mCmAmAmGmAmU*mG*mG | 530 |
| 70 | mU*mCmUmUmGmUmU/i2FU//i2FG//i2FC//i2FC/mUmAmCmAmUmCmUmAmAmGmCmAmGmCmCmG[ademA-GalNAc][ademA-GalNAc][ademA-GalNAc]mGmGmCmUmGmC | 531 | [MePhosphonate-4O-mUs]/i2FU/*/i2FA/*/i2FG//i2FA/mU/i2FG/mUmA/i2FG/mGmCmA/i2FA/mAmCmAmAmGmA*mG*mG | 532 |

-continued

SEQ ID NOs: 393-776 - GalXC™-SCAP Oligonucleotides (modified)

| GalXC-SCAP Oligo | Sense Strand (passenger; 36-mer) | SEQ ID NO: | Antisense Strand (guide; 22-mer) | SEQ ID NO: |
|---|---|---|---|---|
| 71 | mU*mUmUmCmCmCmC/ i2FU//i2FA//i2FC//i2FC/ mUmUmGmUmGmGmUmGmAmGmCmAmGmCmCmG[ademA-GalNAc][ademA-GalNAc][ademA-GalNAc]mGmGmCmUmGmC | 533 | [MePhosphonate-4O-mUs]/i2FC/*/i2FA/*/i2FC//i2FC/ mA/i2FC/mAmA/i2FG/ mGmUmA/i2FG/ mGmGmGmAmAmA*mG*mG | 534 |
| 72 | mU*mUmCmCmCmCmU/ i2FA//i2FC//i2FC//i2FU/ mUmGmUmGmGmUmGmGmAmGmCmAmGmCmCmG[ademA-GalNAc][ademA-GalNAc][ademA-GalNAc]mGmGmCmUmGmC | 535 | [MePhosphonate-4O-mUs]/i2FC/*/i2FC/*/i2FA//i2FC/ mC/i2FA/mCmA/i2FA/ mGmGmU/i2FA/ mGmGmGmGmAmA*mG*mG | 536 |
| 73 | mC*mCmCmUmAmCmC/ i2FU//i2FU//i2FG//i2FU/ mGmGmUmGmGmUmUmAmAmGmCmAmGmCmCmG[ademA-GalNAc][ademA-GalNAc][ademA-GalNAc]mGmGmCmUmGmC | 537 | [MePhosphonate-4O-mUs]/i2FU/*/i2FA/*/i2FA//i2FC/ mC/i2FA/mCmC/i2FA/ mCmAmA/i2FG/ mGmUmAmGmGmG*mG*mG | 538 |
| 74 | mC*mUmAmCmCmUmU/ i2FG//i2FU//i2FG//i2FG/ mUmGmGmUmUmAmUmUmAmGmCmAmGmCmCmG[ademA-GalNAc][ademA-GalNAc][ademA-GalNAc]mGmGmCmUmGmC | 539 | [MePhosphonate-4O-mUs]/i2FA/*/i2FA/*/i2FU//i2FA/ mA/i2FC/mCmA/i2FC/ mCmAmC/i2FA/ mAmGmGmUmAmG*mG*mG | 540 |
| 75 | mU*mAmCmCmUmUmG/ i2FU//i2FG//i2FG//i2FU/ mGmGmUmUmAmUmUmGmAmGmCmAmGmCmCmG[ademA-GalNAc][ademA-GalNAc][ademA-GalNAc]mGmGmCmUmGmC | 541 | [MePhosphonate-4O-mUs]/i2FC/*/i2FA/*/i2FA//i2FU/ mA/i2FA/mCmC/i2FA/ mCmCmA/i2FC/ mAmAmGmGmUmA*mG*mG | 542 |
| 76 | mA*mCmCmUmUmGmU/ i2FG//i2FG//i2FU//i2FG/ mGmUmUmAmUmUmGmGmAmGmCmAmGmCmCmG[ademA-GalNAc][ademA-GalNAc][ademA-GalNAc]mGmGmCmUmGmC | 543 | [MePhosphonate-4O-mUs]/i2FC/*/i2FC/*/i2FA//i2FA/ mU/i2FA/mAmC/i2FC/ mAmCmC/i2FA/ mCmAmAmGmGmU*mG*mG | 544 |
| 77 | mC*mCmUmUmGmUmG/ i2FG//i2FU//i2FG//i2FG/ mUmUmAmUmUmGmGmGmAmGmCmAmGmCmCmG[ademA-GalNAc][ademA-GalNAc][ademA-GalNAc]mGmGmCmUmGmC | 545 | [MePhosphonate-4O-mUs]/i2FU/*/i2FC/*/i2FC//i2FA/ mA/i2FU/mAmA/i2FC/ mCmAmC/i2FC/ mAmCmAmAmGmG*mG*mG | 546 |
| 78 | mC*mUmUmGmUmGmG/ i2FU//i2FG//i2FG//i2FU/ mUmAmUmUmGmGmGmUmAmGmCmAmGmCmCmG[ademA-GalNAc][ademA-GalNAc][ademA-GalNAc]mGmGmCmUmGmC | 547 | [MePhosphonate-4O-mUs]/i2FA/*/i2FC/*/i2FC//i2FC/ mA/i2FA/mUmA/i2FA/ mCmCmA/i2FC/ mCmAmCmAmAmG*mG*mG | 548 |
| 79 | mU*mUmGmUmGmGmU/ i2FG//i2FG//i2FU//i2FU/ mAmUmUmGmGmGmUmUmAmGmCmAmGmCmCmG[ademA-GalNAc][ademA-GalNAc][ademA-GalNAc]mGmGmCmUmGmC | 549 | [MePhosphonate-4O-mUs]/i2FA/*/i2FA/*/i2FC//i2FC/ mC/i2FA/mAmU/i2FA/ mAmCmC/i2FA/ mCmCmAmCmAmA*mG*mG | 550 |
| 80 | mUmGmUmGmGmUmG/ i2FG//i2FU//i2FU//i2FA/ mUmUmGmGmGmUmUmAmAmGmCmAmGmCmCmG[ademA-GalNAc][ademA-GalNAc][ademA-GalNAc]mGmGmCmUmGmC | 551 | [MePhosphonate-4O-mUs]/i2FU/*/i2FA/*/i2FA//i2FC/ mC/i2FC/mAmA/i2FU/ mAmAmC/i2FC/ mAmCmCmAmCmA*mG*mG | 552 |
| 81 | mG*mUmGmGmUmGmG/ i2FU//i2FU//i2FA//i2FU/ mUmGmGmGmUmUmAmGmAmGmCmAmGmCmCmG[ademA-GalNAc][ademA-GalNAc][ademA-GalNAc]mGmGmCmUmGmC | 553 | [MePhosphonate-4O-mUs]/i2FC/*/i2FU/*/i2FA//i2FA/ mC/i2FC/mCmA/i2FA/ mUmAmA/i2FC/ mCmAmCmCmAmC*mG*mG | 554 |
| 82 | mU*mGmGmUmGmGmU/ i2FU//i2FA//i2FU//i2FU/ mGmGmGmUmUmAmGmAmAmGmCmAmGmCmCmG[ademA-GalNAc][ademA-GalNAc][ademA-GalNAc]mGmGmCmUmGmC | 555 | [MePhosphonate-4O-mUs]/i2FU/*/i2FC/*/i2FU//i2FA/ mA/i2FC/mCmC/i2FA/ mAmUmA/i2FA/ mCmCmAmCmCmA*mG*mG | 556 |

-continued

SEQ ID NOs: 393-776 - GalXC™-SCAP Oligonucleotides (modified)

| GalXC-SCAP Oligo | Sense Strand (passenger; 36-mer) | SEQ ID NO: | Antisense Strand (guide; 22-mer) | SEQ ID NO: |
|---|---|---|---|---|
| 83 | mG*mGmUmGmGmUmU/i2FA//i2FU//i2FU//i2FG/mGmGmUmUmAmGmAmGmAmGmCmAmGmCmCmG[ademA-GalNAc][ademA-GalNAc][ademA-GalNAc]mGmGmCmUmGmC | 557 | [MePhosphonate-4O-mUs]/i2FC/*/i2FU/*/i2FC//i2FU/mA/i2FA/mCmC/i2FC/mAmAmU/i2FA/mAmCmCmAmCmC*mG*mG | 558 |
| 84 | mG*mUmGmGmUmUmA/i2FU//i2FU//i2FG//i2FG/mGmUmUmAmGmAmGmAmAmGmCmAmGmCmCmG[ademA-GalNAc][ademA-GalNAc][ademA-GalNAc]mGmGmCmUmGmC | 559 | [MePhosphonate-4O-mUs]/i2FU/*/i2FC/*/i2FU//i2FC/mU/i2FA/mAmC/i2FC/mCmAmA/i2FU/mAmAmCmCmAmC*mG*mG | 560 |
| 85 | mU*mGmGmUmUmAmU/i2FU//i2FG//i2FG//i2FG/mUmUmAmGmAmGmAmAmAmGmCmAmGmCmCmG[ademA-GalNAc][ademA-GalNAc][ademA-GalNAc]mGmGmCmUmGmC | 561 | [MePhosphonate-4O-mUs]/i2FU/*/i2FU/*/i2FC//i2FU/mC/i2FU/mAmA/i2FC/mCmCmA/i2FA/mUmAmAmCmCmA*mG*mG | 562 |
| 86 | mG*mGmUmUmAmUmU/i2FG//i2FG//i2FG//i2FU/mUmAmGmAmGmAmAmUmAmGmCmAmGmCmCmG[ademA-GalNAc][ademA-GalNAc][ademA-GalNAc]mGmGmCmUmGmC | 563 | [MePhosphonate-4O-mUs]/i2FA/*/i2FU/*/i2FU//i2FC/mU/i2FC/mUmA/i2FA/mCmCmC/i2FA/mAmUmAmAmCmC*mG*mG | 564 |
| 87 | mG*mUmUmAmUmUmG/i2FG//i2FG//i2FU//i2FU/mAmGmAmGmAmAmUmGmAmGmCmAmGmCmCmG[ademA-GalNAc][ademA-GalNAc][ademA-GalNAc]mGmGmCmUmGmC | 565 | [MePhosphonate-4O-mUs]/i2FC/*/i2FA/*/i2FU//i2FU/mC/i2FU/mCmU/i2FA/mAmCmC/i2FC/mAmAmUmAmAmC*mG*mG | 566 |
| 88 | mU*mUmAmUmUmGmG/i2FG//i2FU//i2FU//i2FA/mGmAmGmAmAmUmGmUmAmGmCmAmGmCmCmG[ademA-GalNAc][ademA-GalNAc][ademA-GalNAc]mGmGmCmUmGmC | 567 | [MePhosphonate-4O-mUs]/i2FA/*/i2FC/*/i2FA//i2FU/mU/i2FC/mUmC/i2FU/mAmAmC/i2FC/mCmAmAmUmAmA*mG*mG | 568 |
| 89 | mA*mUmUmGmGmGmU/i2FU//i2FA//i2FG//i2FA/mGmAmAmUmGmUmGmUmAmGmCmAmGmCmCmG[ademA-GalNAc][ademA-GalNAc][ademA-GalNAc]mGmGmCmUmGmC | 569 | [MePhosphonate-4O-mUs]/i2FA/*/i2FC/*/i2FA//i2FC/mA/i2FU/mUmC/i2FU/mCmUmA/i2FA/mCmCmCmAmAmU*mG*mG | 570 |
| 90 | mU*mUmGmGmGmUmU/i2FA//i2FG//i2FA//i2FG/mAmAmUmGmUmGmUmUmAmGmCmAmGmCmCmG[ademA-GalNAc][ademA-GalNAc][ademA-GalNAc]mGmGmCmUmGmC | 571 | [MePhosphonate-4O-mUs]/i2FA/*/i2FA/*/i2FC//i2FA/mC/i2FA/mUmU/i2FC/mUmCmU/i2FA/mAmCmCmCmAmA*mG*mG | 572 |
| 91 | mG*mGmUmUmAmGmA/i2FG//i2FA//i2FA//i2FU/mGmUmGmUmUmGmGmUmAmGmCmAmGmCmCmG[ademA-GalNAc][ademA-GalNAc][ademA-GalNAc]mGmGmCmUmGmC | 573 | [MePhosphonate-4O-mUs]/i2FA/*/i2FC/*/i2FC//i2FA/mA/i2FC/mAmC/i2FA/mUmUmC/i2FU/mCmUmAmAmCmC*mG*mG | 574 |
| 92 | mG*mUmUmAmGmAmG/i2FA//i2FA//i2FU//i2FG/mUmGmUmUmGmGmUmGmAmGmCmAmGmCmCmG[ademA-GalNAc][ademA-GalNAc][ademA-GalNAc]mGmGmCmUmGmC | 575 | [MePhosphonate-4O-mUs]/i2FC/*/i2FA/*/i2FC//i2FC/mA/i2FA/mCmA/i2FC/mAmUmU/i2FC/mUmCmUmAmAmC*mG*mG | 576 |
| 93 | mU*mUmAmGmAmGmA/i2FA//i2FU//i2FG//i2FU/mGmUmUmGmGmUmGmCmAmGmCmAmGmCmCmG[ademA-GalNAc][ademA-GalNAc][ademA-GalNAc]mGmGmCmUmGmC | 577 | [MePhosphonate-4O-mUs]/i2FG/*/i2FC/*/i2FA//i2FC/mC/i2FA/mAmC/i2FA/mCmAmU/i2FU/mCmUmCmUmAmA*mG*mG | 578 |
| 94 | mU*mAmGmAmGmAmA/i2FU//i2FG//i2FU//i2FG/mUmUmGmGmUmGmCmUmAmGmCmAmGmCmCmG[ademA-GalNAc][ademA-GalNAc][ademA-GalNAc]mGmGmCmUmGmC | 579 | [MePhosphonate-4O-mUs]/i2FA/*/i2FG/*/i2FC//i2FA/mC/i2FC/mAmA/i2FC/mAmCmA/i2FU/mUmCmUmCmUmA*mG*mG | 580 |

-continued

SEQ ID NOs: 393-776 - GalXC™-SCAP Oligonucleotides (modified)

| GalXC-SCAP Oligo | Sense Strand (passenger; 36-mer) | SEQ ID NO: | Antisense Strand (guide; 22-mer) | SEQ ID NO: |
|---|---|---|---|---|
| 95 | mA*mGmAmGmAmAmU/ i2FG//i2FU//i2FG//i2FU/ mUmGmGmUmGmCmUmCmAmGmCmAmGmCmCmG[ademA-GalNAc][ademA-GalNAc][ademA-GalNAc]mGmGmCmUmGmC | 581 | [MePhosphonate-4O-mUs]/i2FG/*/i2FA/*/i2FG//i2FC/ mA/i2FC/mCmA/i2FA/ mCmAmC/i2FA/ mUmUmCmUmCmU*mG*mG | 582 |
| 96 | mG*mAmGmAmAmUmG/ i2FU//i2FG//i2FU//i2FU/ mGmGmUmGmCmUmCmAmAmGmCmAmGmCmCmG[ademA-GalNAc][ademA-GalNAc][ademA-GalNAc]mGmGmCmUmGmC | 583 | [MePhosphonate-4O-mUs]/i2FU/*/i2FG/*/i2FA//i2FG/ mC/i2FA/mCmC/i2FA/ mAmCmA/i2FC/ mAmUmUmCmUmC*mG*mG | 584 |
| 97 | mA*mGmAmAmUmGmU/ i2FG//i2FU//i2FU//i2FG/ mGmUmGmCmUmCmAmCmAmGmCmAmGmCmCmG[ademA-GalNAc][ademA-GalNAc][ademA-GalNAc]mGmGmCmUmGmC | 585 | [MePhosphonate-4O-mUs]/i2FG/*/i2FU/*/i2FG//i2FA/ mG/i2FC/mAmC/i2FC/ mAmAmC/i2FA/ mCmAmUmUmCmU*mG*mG | 586 |
| 98 | mA*mAmUmGmUmGmU/ i2FU//i2FG//i2FG//i2FU/ mGmCmUmCmAmCmCmAmAmGmCmAmGmCmCmG[ademA-GalNAc][ademA-GalNAc][ademA-GalNAc]mGmGmCmUmGmC | 587 | [MePhosphonate-4O-mUs]/i2FU/*/i2FG/*/i2FG//i2FU/ mG/i2FA/mGmC/i2FA/ mCmCmA/i2FA/ mCmAmCmAmUmU*mG*mG | 588 |
| 99 | mA*mUmGmUmGmUmU/ i2FG//i2FG//i2FU//i2FG/ mCmUmCmAmCmCmAmAmAmGmCmAmGmCmCmG[ademA-GalNAc][ademA-GalNAc][ademA-GalNAc]mGmGmCmUmGmC | 589 | [MePhosphonate-4O-mUs]/i2FU/*/i2FU/*/i2FG//i2FG/ mU/i2FG/mAmG/i2FC/ mAmCmC/i2FA/ mAmCmAmCmAmU*mG*mG | 590 |
| 100 | mU*mGmUmGmUmUmG/ i2FG//i2FU//i2FG//i2FC/ mUmCmAmCmCmAmAmGmAmGmCmAmGmCmCmG[ademA-GalNAc][ademA-GalNAc][ademA-GalNAc]mGmGmCmUmGmC | 591 | [MePhosphonate-4O-mUs]/i2FC/*/i2FU/*/i2FU//i2FG/ mG/i2FU/mGmA/i2FG/ mCmAmC/i2FC/ mAmAmCmAmCmA*mG*mG | 592 |
| 101 | mU*mGmGmUmCmCmA/ i2FU//i2FC//i2FA//i2FU/ mGmAmAmGmAmAmCmAmAmGmCmAmGmCmCmG[ademA-GalNAc][ademA-GalNAc][ademA-GalNAc]mGmGmCmUmGmC | 593 | [MePhosphonate-4O-mUs]/i2FU/*/i2FG/*/i2FU//i2FU/ mC/i2FU/mUmC/i2FA/ mUmGmA/i2FU/ mGmGmAmCmCmA*mG*mG | 594 |
| 102 | mG*mGmUmCmCmAmU/ i2FC//i2FA//i2FU//i2FG/ mAmAmGmAmAmCmAmUmAmGmCmAmGmCmCmG[ademA-GalNAc][ademA-GalNAc][ademA-GalNAc]mGmGmCmUmGmC | 595 | [MePhosphonate-4O-mUs]/i2FA/*/i2FU/*/i2FG//i2FU/ mU/i2FC/mUmU/i2FC/ mAmUmG/i2FA/ mUmGmGmAmCmC*mG*mG | 596 |
| 103 | mC*mUmGmAmCmUmU/ i2FC//i2FU//i2FU//i2FC/ mCmUmUmCmAmGmAmUmAmGmCmAmGmCmCmG[ademA-GalNAc][ademA-GalNAc][ademA-GalNAc]mGmGmCmUmGmC | 597 | [MePhosphonate-4O-mUs]/i2FA/*/i2FU/*/i2FC//i2FU/ mG/i2FA/mAmG/i2FG/ mAmAmG/i2FA/ mAmGmUmCmAmG*mG*mG | 598 |
| 104 | mA*mCmUmUmCmUmU/ i2FC//i2FC//i2FU//i2FU/ mCmAmGmAmUmGmCmUmAmGmCmAmGmCmCmG[ademA-GalNAc][ademA-GalNAc][ademA-GalNAc]mGmGmCmUmGmC | 599 | [MePhosphonate-4O-mUs]/i2FA/*/i2FG/*/i2FC//i2FA/ mU/i2FC/mUmG/i2FA/ mAmGmG/i2FA/ mAmGmAmAmGmU*mG*mG | 600 |
| 105 | mU*mCmCmUmUmCmA/ i2FG//i2FA//i2FU//i2FG/ mCmUmGmUmUmUmUmUmAmGmCmAmGmCmCmG[ademA-GalNAc][ademA-GalNAc][ademA-GalNAc]mGmGmCmUmGmC | 601 | [MePhosphonate-4O-mUs]/i2FA/*/i2FA/*/i2FA//i2FA/ mA/i2FC/mAmG/i2FC/ mAmUmC/i2FU/ mGmAmAmGmGmA*mG*mG | 602 |
| 106 | mC*mCmUmUmCmAmG/ i2FA//i2FU//i2FG//i2FC/ mUmGmUmUmUmUmUmCmAmGmCmAmGmCmCmG[ademA-GalNAc][ademA-GalNAc][ademA-GalNAc]mGmGmCmUmGmC | 603 | [MePhosphonate-4O-mUs]/i2FG/*/i2FA/*/i2FA//i2FA/ mA/i2FA/mCmA/i2FG/ mCmAmU/i2FC/ mUmGmAmAmGmG*mG*mG | 604 |

-continued

SEQ ID NOs: 393-776 - GalXC ™-SCAP Oligonucleotides (modified)

| GalXC-SCAP Oligo | Sense Strand (passenger; 36-mer) | SEQ ID NO: | Antisense Strand (guide; 22-mer) | SEQ ID NO: |
|---|---|---|---|---|
| 107 | mC*mUmUmCmAmGmA/i2FU//i2FG//i2FC//i2FU/mGmUmUmUmUmUmCmAmAmGmCmAmGmCmCmG[ademA-GalNAc][ademA-GalNAc][ademA-GalNAc]mGmGmCmUmGmC | 605 | [MePhosphonate-4O-mUs]/i2FU/*/i2FG/*/i2FA//i2FA/mA/i2FA/mAmC/i2FA/mGmCmA/i2FU/mCmUmGmAmAmG*mG*mG | 606 |
| 108 | mU*mUmCmAmGmAmU/i2FG//i2FC//i2FU//i2FG/mUmUmUmUmUmCmAmCmAmGmCmAmGmCmCmG[ademA-GalNAc][ademA-GalNAc][ademA-GalNAc]mGmGmCmUmGmC | 607 | [MePhosphonate-4O-mUs]/i2FG/*/i2FU/*/i2FG//i2FA/mA/i2FA/mAmA/i2FC/mAmGmC/i2FA/mUmCmUmGmAmA*mG*mG | 608 |
| 109 | mC*mAmGmAmUmGmC/i2FU//i2FG//i2FU//i2FU/mUmUmUmCmAmCmCmAmAmGmCmAmGmCmCmG[ademA-GalNAc][ademA-GalNAc][ademA-GalNAc]mGmGmCmUmGmC | 609 | [MePhosphonate-4O-mUs]/i2FU/*/i2FG/*/i2FG//i2FU/mG/i2FA/mAmA/i2FA/mAmCmA/i2FG/mCmAmUmCmUmG*mG*mG | 610 |
| 110 | mA*mGmAmUmGmCmU/i2FG//i2FU//i2FU//i2FU/mUmUmCmAmCmCmAmCmAmGmCmAmGmCmCmG[ademA-GalNAc][ademA-GalNAc][ademA-GalNAc]mGmGmCmUmGmC | 611 | [MePhosphonate-4O-mUs]/i2FG/*/i2FU/*/i2FG//i2FG/mU/i2FG/mAmA/i2FA/mAmAmC/i2FA/mGmCmAmUmCmU*mG*mG | 612 |
| 111 | mG*mAmUmGmCmUmG/i2FU//i2FU//i2FU//i2FU/mUmCmAmCmCmAmCmUmAmGmCmAmGmCmCmG[ademA-GalNAc][ademA-GalNAc][ademA-GalNAc]mGmGmCmUmGmC | 613 | [MePhosphonate-4O-mUs]/i2FA/*/i2FG/*/i2FU//i2FG/mG/i2FU/mGmA/i2FA/mAmAmA/i2FC/mAmGmCmAmUmC*mG*mG | 614 |
| 112 | mA*mUmGmCmUmGmU/i2FU//i2FU//i2FU//i2FU/mCmAmCmCmAmCmUmGmAmGmCmAmGmCmCmG[ademA-GalNAc][ademA-GalNAc][ademA-GalNAc]mGmGmCmUmGmC | 615 | [MePhosphonate-4O-mUs]/i2FC/*/i2FA/*/i2FG//i2FU/mG/i2FG/mUmG/i2FA/mAmAmA/i2FA/mCmAmGmCmAmU*mG*mG | 616 |
| 113 | mU*mGmCmUmGmUmU/i2FU//i2FU//i2FU//i2FC/mAmCmCmAmCmUmGmUmAmGmCmAmGmCmCmG[ademA-GalNAc][ademA-GalNAc][ademA-GalNAc]mGmGmCmUmGmC | 617 | [MePhosphonate-4O-mUs]/i2FA/*/i2FC/*/i2FA//i2FG/mU/i2FG/mGmU/i2FG/mAmAmA/i2FA/mAmCmAmGmCmA*mG*mG | 618 |
| 114 | mG*mCmUmGmUmUmU/i2FU//i2FU//i2FC//i2FA/mCmCmAmCmUmGmUmCmAmGmCmAmGmCmCmG[ademA-GalNAc][ademA-GalNAc][ademA-GalNAc]mGmGmCmUmGmC | 619 | [MePhosphonate-4O-mUs]/i2FG/*/i2FA/*/i2FC//i2FA/mG/i2FU/mGmG/i2FU/mGmAmA/i2FA/mAmAmCmAmGmC*mG*mG | 620 |
| 115 | mU*mGmUmUmUmUmU/i2FC//i2FA//i2FC//i2FC/mAmCmUmGmUmCmCmUmAmGmCmAmGmCmCmG[ademA-GalNAc][ademA-GalNAc][ademA-GalNAc]mGmGmCmUmGmC | 621 | [MePhosphonate-4O-mUs]/i2FA/*/i2FG/*/i2FG//i2FA/mC/i2FA/mGmU/i2FG/mGmUmG/i2FA/mAmAmAmAmCmA*mG*mG | 622 |
| 116 | mG*mUmUmUmUmUmC/i2FA//i2FC//i2FC//i2FA/mCmUmGmUmCmCmUmGmAmGmCmAmGmCmCmG[ademA-GalNAc][ademA-GalNAc][ademA-GalNAc]mGmGmCmUmGmC | 623 | [MePhosphonate-4O-mUs]/i2FC/*/i2FA/*/i2FG//i2FG/mA/i2FC/mAmG/i2FU/mGmGmU/i2FG/mAmAmAmAmAmC*mG*mG | 624 |
| 117 | mU*mUmUmUmUmCmA/i2FC//i2FC//i2FA//i2FC/mUmGmUmCmCmUmGmUmAmGmCmAmGmCmCmG[ademA-GalNAc][ademA-GalNAc][ademA-GalNAc]mGmGmCmUmGmC | 625 | [MePhosphonate-4O-mUs]/i2FA/*/i2FC/*/i2FA//i2FG/mG/i2FA/mCmA/i2FG/mUmGmG/i2FU/mGmAmAmAmAmA*mG*mG | 626 |
| 118 | mU*mUmUmUmCmAmC/i2FC//i2FA//i2FC//i2FU/mGmUmCmCmUmGmUmCmAmGmCmAmGmCmCmG[ademA-GalNAc][ademA-GalNAc][ademA-GalNAc]mGmGmCmUmGmC | 627 | [MePhosphonate-4O-mUs]/i2FG/*/i2FA/*/i2FC//i2FA/mG/i2FG/mAmC/i2FA/mGmUmG/i2FG/mUmGmAmAmAmA*mG*mG | 628 |

-continued

SEQ ID NOs: 393-776 - GalXC™-SCAP Oligonucleotides (modified)

| GalXC-SCAP Oligo | Sense Strand (passenger; 36-mer) | SEQ ID NO: | Antisense Strand (guide; 22-mer) | SEQ ID NO: |
|---|---|---|---|---|
| 119 | mU*mUmCmAmCmCmA/i2FC//i2FU//i2FG//i2FU/mCmCmUmGmUmCmCmAmAmGmCmAmGmCmCmG[ademA-GalNAc][ademA-GalNAc][ademA-GalNAc]mGmGmCmUmGmC | 629 | [MePhosphonate-4O-mUs]/i2FU/*/i2FG/*/i2FG//i2FA/mC/i2FA/mGmG/i2FA/mCmAmG/i2FU/mGmGmUmGmAmA*mG*mG | 630 |
| 120 | mC*mAmCmCmAmCmU/i2FG//i2FU//i2FC//i2FC/mUmGmUmCmCmAmUmUmAmGmCmAmGmCmCmG[ademA-GalNAc][ademA-GalNAc][ademA-GalNAc]mGmGmCmUmGmC | 631 | [MePhosphonate-4O-mUs]/i2FA/*/i2FA/*/i2FU//i2FG/mG/i2FA/mCmA/i2FG/mGmAmC/i2FA/mGmUmGmGmUmG*mG*mG | 632 |
| 121 | mA*mCmCmAmCmUmG/i2FU//i2FC//i2FC//i2FU/mGmUmCmCmAmUmUmGmAmGmCmAmGmCmCmG[ademA-GalNAc][ademA-GalNAc][ademA-GalNAc]mGmGmCmUmGmC | 633 | [MePhosphonate-4O-mUs]/i2FC/*/i2FA/*/i2FA//i2FU/mG/i2FG/mAmC/i2FA/mGmGmA/i2FC/mAmGmUmGmGmU*mG*mG | 634 |
| 122 | mC*mCmAmCmUmGmU/i2FC//i2FC//i2FU//i2FG/mUmCmCmAmUmUmGmAmAmGmCmAmGmCmCmG[ademA-GalNAc][ademA-GalNAc][ademA-GalNAc]mGmGmCmUmGmC | 635 | [MePhosphonate-4O-mUs]/i2FU/*/i2FC/*/i2FA//i2FA/mU/i2FG/mGmA/i2FC/mAmGmG/i2FA/mCmAmGmUmGmG*mG*mG | 636 |
| 123 | mC*mAmCmUmGmUmC/i2FC//i2FU//i2FG//i2FU/mCmCmAmUmUmGmAmCmAmGmCmAmGmCmCmG[ademA-GalNAc][ademA-GalNAc][ademA-GalNAc]mGmGmCmUmGmC | 637 | [MePhosphonate-4O-mUs]/i2FG/*/i2FU/*/i2FC//i2FA/mA/i2FU/mGmG/i2FA/mCmAmG/i2FG/mAmCmAmGmUmG*mG*mG | 638 |
| 124 | mA*mCmUmGmUmCmC/i2FU//i2FG//i2FU//i2FC/mCmAmUmUmGmAmCmAmAmGmCmAmGmCmCmG[ademA-GalNAc][ademA-GalNAc][ademA-GalNAc]mGmGmCmUmGmC | 639 | [MePhosphonate-4O-mUs]/i2FU/*/i2FG/*/i2FU//i2FC/mA/i2FA/mUmG/i2FG/mAmCmA/i2FG/mGmAmCmAmGmUmG*mG | 640 |
| 125 | mC*mUmAmAmGmCmU/i2FA//i2FC//i2FC//i2FU/mGmAmGmAmAmCmCmAmAmGmCmAmGmCmCmG[ademA-GalNAc][ademA-GalNAc][ademA-GalNAc]mGmGmCmUmGmC | 641 | [MePhosphonate-4O-mUs]/i2FU/*/i2FG/*/i2FG//i2FU/mU/i2FC/mUmC/i2FA/mGmGmU/i2FA/mGmCmUmUmAmG*mG*mG | 642 |
| 126 | mG*mAmGmGmUmCmC/i2FA//i2FG//i2FC//i2FA/mGmAmGmGmUmUmGmUmAmGmCmAmGmCmCmG[ademA-GalNAc][ademA-GalNAc][ademA-GalNAc]mGmGmCmUmGmC | 643 | [MePhosphonate-4O-mUs]/i2FA/*/i2FC/*/i2FA//i2FA/mC/i2FC/mUmC/i2FU/mGmCmU/i2FG/mGmAmCmCmUmC*mG*mG | 644 |
| 127 | mG*mCmAmGmAmGmG/i2FU//i2FU//i2FG//i2FU/mCmCmAmUmGmAmCmAmAmGmCmAmGmCmCmG[ademA GalNAc][ademA-GalNAc][ademA-GalNAc]mGmGmCmUmGmC | 645 | [MePhosphonate-4O-mUs]/i2FU/*/i2FG/*/i2FU//i2FC/mA/i2FU/mGmG/i2FA/mCmAmA/i2FC/mCmUmCmUmGmC*mG*mG | 646 |
| 128 | mC*mAmGmAmGmGmU/i2FU//i2FG//i2FU//i2FC/mCmAmUmGmAmCmAmGmAmGmCmAmGmCmCmG[ademA-GalNAc][ademA-GalNAc][ademA-GalNAc]mGmGmCmUmGmC | 647 | [MePhosphonate-4O-mUs]/i2FC/*/i2FU/*/i2FG//i2FU/mC/i2FA/mUmG/i2FG/mAmCmA/i2FA/mCmCmUmCmUmG*mG*mG | 648 |
| 129 | mG*mAmGmGmAmUmG/i2FA//i2FG//i2FG//i2FA/mAmCmUmUmUmGmGmAmAmGmCmAmGmCmCmG[ademA-GalNAc][ademA-GalNAc][ademA-GalNAc]mGmGmCmUmGmC | 649 | [MePhosphonate-4O-mUs]/i2FU/*/i2FC/*/i2FC//i2FA/mA/i2FA/mGmU/i2FU/mCmCmU/i2FC/mAmUmCmCmUmC*mG*mG | 650 |
| 130 | mG*mAmAmCmUmUmU/i2FG//i2FG//i2FA//i2FG/mGmAmAmAmUmUmGmUmAmGmCmAmGmCmCmG[ademA-GalNAc][ademA-GalNAc][ademA-GalNAc]mGmGmCmUmGmC | 651 | [MePhosphonate-4O-mUs]/i2FA/*/i2FC/*/i2FA//i2FA/mU/i2FU/mUmC/i2FC/mUmCmC/i2FA/mAmAmGmUmUmC*mG*mG | 652 |

-continued

SEQ ID NOs: 393-776 - GalXC™-SCAP Oligonucleotides (modified)

| GalXC-SCAP Oligo | Sense Strand (passenger; 36-mer) | SEQ ID NO: | Antisense Strand (guide; 22-mer) | SEQ ID NO: |
|---|---|---|---|---|
| 131 | mG*mAmCmGmCmUmC/i2FU//i2FU//i2FC//i2FA/mGmCmUmAmUmUmAmCmAmGmCmAmGmCmCmG[ademA-GalNAc][ademA-GalNAc][ademA-GalNAc]mGmGmCmUmGmC | 653 | [MePhosphonate-4O-mUs]/i2FG/*/i2FU/*/i2FA//i2FA/mU/i2FA/mGmC/i2FU/mGmAmA/i2FG/mAmGmCmGmUmC*mG*mG | 654 |
| 132 | mA*mCmGmCmUmCmU/i2FU//i2FC//i2FA//i2FG/mCmUmAmUmUmAmCmAmAmGmCmAmGmCmCmG[ademA-GalNAc][ademA-GalNAc][ademA-GalNAc]mGmGmCmUmGmC | 655 | [MePhosphonate-4O-mUs]/i2FU/*/i2FG/*/i2FU//i2FA/mA/i2FU/mAmG/i2FC/mUmGmA/i2FA/mGmAmGmCmGmU*mG*mG | 656 |
| 133 | mC*mGmCmUmCmUmU/i2FC//i2FA//i2FG//i2FC/mUmAmUmUmAmCmAmAmAmGmCmAmGmCmCmG[ademA-GalNAc][ademA-GalNAc][ademA-GalNAc]mGmGmCmUmGmC | 657 | [MePhosphonate-4O-mUs]/i2FU/*/i2FU/*/i2FG//i2FU/mA/i2FA/mUmA/i2FG/mCmUmG/i2FA/mAmGmAmGmCmG*mG*mG | 658 |
| 134 | mG*mCmUmCmUmUmC/i2FA//i2FG//i2FC//i2FU/mAmUmUmAmCmAmAmCmAmGmCmAmGmCmCmG[ademA-GalNAc][ademA-GalNAc][ademA-GalNAc]mGmGmCmUmGmC | 659 | [MePhosphonate-4O-mUs]/i2FG/*/i2FU/*/i2FU//i2FG/mU/i2FA/mAmU/i2FA/mGmCmU/i2FG/mAmAmGmAmGmC*mG*mG | 660 |
| 135 | mC*mUmCmUmUmCmA/i2FG//i2FC//i2FU//i2FA/mUmUmAmCmAmAmCmAmAmGmCmAmGmCmCmG[ademA-GalNAc][ademA-GalNAc][ademA-GalNAc]mGmGmCmUmGmC | 661 | [MePhosphonate-4O-mUs]/i2FU/*/i2FG/*/i2FU//i2FU/mG/i2FU/mAmA/i2FU/mAmGmC/i2FU/mGmAmAmGmAmG*mG*mG | 662 |
| 136 | mU*mCmUmUmCmAmG/i2FC//i2FU//i2FA//i2FU/mUmAmCmAmAmCmAmUmAmGmCmAmGmCmCmG[ademA-GalNAc][ademA-GalNAc][ademA-GalNAc]mGmGmCmUmGmC | 663 | [MePhosphonate-4O-mUs]/i2FA/*/i2FU/*/i2FG//i2FU/mU/i2FG/mUmA/i2FA/mUmAmG/i2FC/mUmGmAmAmGmA*mG*mG | 664 |
| 137 | mC*mUmUmCmAmGmC/i2FU//i2FA//i2FU//i2FU/mAmCmAmAmCmAmUmCmAmGmCmAmGmCmCmG[ademA-GalNAc][ademA-GalNAc][ademA-GalNAc]mGmGmCmUmGmC | 665 | [MePhosphonate-4O-mUs]/i2FG/*/i2FA/*/i2FU//i2FG/mU/i2FU/mGmU/i2FA/mAmUmA/i2FG/mCmUmGmAmAmG*mG*mG | 666 |
| 138 | mU*mUmCmAmGmCmU/i2FA//i2FU//i2FU//i2FA/mCmAmAmCmAmUmCmAmAmGmCmAmGmCmCmG[ademA-GalNAc][ademA-GalNAc][ademA-GalNAc]mGmGmCmUmGmC | 667 | [MePhosphonate-4O-mUs]/i2FU/*/i2FG/*/i2FA//i2FU/mG/i2FU/mUmG/i2FU/mAmAmU/i2FA/mGmCmUmGmAmA*mG*mG | 668 |
| 139 | mC*mCmAmGmCmCmU/i2FG//i2FA//i2FC//i2FC/mUmCmAmCmCmUmGmCmAmGmCmAmGmCmCmG[ademA-GalNAc][ademA-GalNAc][ademA-GalNAc]mGmGmCmUmGmC | 669 | [MePhosphonate-4O-mUs]/i2FG/*/i2FC/*/i2FA//i2FG/mG/i2FU/mGmA/i2FG/mGmUmC/i2FA/mGmGmCmUmGmG*mG*mG | 670 |
| 140 | mC*mAmGmCmCmUmG/i2FA//i2FC//i2FC//i2FU/mCmAmCmCmUmGmCmUmAmGmCmAmGmCmCmG[ademA-GalNAc][ademA-GalNAc][ademA-GalNAc]mGmGmCmUmGmC | 671 | [MePhosphonate-4O-mUs]/i2FA/*/i2FG/*/i2FC//i2FA/mG/i2FG/mUmG/i2FA/mGmGmU/i2FC/mAmGmGmCmUmG*mG*mG | 672 |
| 141 | mA*mGmCmCmUmGmA/i2FC//i2FC//i2FU//i2FC/mAmCmCmUmGmCmUmUmAmGmCmAmGmCmCmG[ademA-GalNAc][ademA-GalNAc][ademA-GalNAc]mGmGmCmUmGmC | 673 | [MePhosphonate-4O-mUs]/i2FA/*/i2FA/*/i2FG//i2FC/mA/i2FG/mGmU/i2FG/mAmGmG/i2FU/mCmAmGmGmCmU*mG*mG | 674 |
| 142 | mG*mCmCmUmGmAmC/i2FC//i2FU//i2FC//i2FA/mCmCmUmGmCmUmUmAmAmGmCmAmGmCmCmG[ademA-GalNAc][ademA-GalNAc][ademA-GalNAc]mGmGmCmUmGmC | 675 | [MePhosphonate-4O-mUs]/i2FU/*/i2FA/*/i2FA//i2FG/mC/i2FA/mGmG/i2FU/mGmAmG/i2FG/mUmCmAmGmGmC*mG*mG | 676 |

-continued

| SEQ ID NOs: 393-776 - GalXC ™-SCAP Oligonucleotides (modified) | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 143 | mC*mCmUmGmAmCmC/i2FU//i2FC//i2FA//i2FC/mCmUmGmCmUmUmAmAmAmGmCmAmGmCmCmG[ademA-GalNAc][ademA-GalNAc][ademA-GalNAc]mGmGmCmUmGmC | 677 | [MePhosphonate-4O-mUs]/i2FU/*/i2FU/*/i2FA//i2FA/mG/i2FC/mAmG/i2FG/mUmGmA/i2FG/mGmUmCmAmGmG*mG*mG | 678 |
| 144 | mC*mUmGmAmCmCmU/i2FC//i2FA//i2FC//i2FC/mUmGmCmUmUmAmAmUmAmGmCmAmGmCmCmG[ademA-GalNAc][ademA-GalNAc][ademA-GalNAc]mGmGmCmUmGmC | 679 | [MePhosphonate-4O-mUs]/i2FA/*/i2FU/*/i2FU//i2FA/mA/i2FG/mCmA/i2FG/mGmUmG/i2FA/mGmGmUmCmAmG*mG*mG | 680 |
| 145 | mU*mGmAmCmCmUmC/i2FA//i2FC//i2FC//i2FU/mGmCmUmUmAmAmUmUmAmGmCmAmGmCmCmG[ademA-GalNAc][ademA-GalNAc][ademA-GalNAc]mGmGmCmUmGmC | 681 | [MePhosphonate-4O-mUs]/i2FA/*/i2FA/*/i2FU//i2FU/mA/i2FA/mGmC/i2FA/mGmGmU/i2FG/mAmGmGmUmCmA*mG*mG | 682 |
| 146 | mG*mAmCmCmUmCmA/i2FC//i2FC//i2FU//i2FG/mCmUmUmAmAmUmUmGmAmGmCmAmGmCmCmG[ademA-GalNAc][ademA-GalNAc][ademA-GalNAc]mGmGmCmUmGmC | 683 | [MePhosphonate-4O-mUs]/i2FC/*/i2FA/*/i2FA//i2FU/mU/i2FA/mAmG/i2FC/mAmGmG/i2FU/mGmAmGmGmUmC*mG*mG | 684 |
| 147 | mA*mCmCmUmCmAmC/i2FC//i2FU//i2FG//i2FC/mUmUmAmAmUmUmGmAmAmGmCmAmGmCmCmG[ademA-GalNAc][ademA-GalNAc][ademA-GalNAc]mGmGmCmUmGmC | 685 | [MePhosphonate-4O-mUs]/i2FU/*/i2FC/*/i2FA//i2FA/mU/i2FU/mAmA/i2FG/mCmAmG/i2FG/mUmGmAmGmGmU*mG*mG | 686 |
| 148 | mC*mCmUmCmAmCmC/i2FU//i2FG//i2FC//i2FU/mUmAmAmUmUmGmAmCmAmGmCmAmGmCmCmG[ademA-GalNAc][ademA-GalNAc][ademA-GalNAc]mGmGmCmUmGmC | 687 | [MePhosphonate-4O-mUs]/i2FG/*/i2FU/*/i2FC//i2FA/mA/i2FU/mUmA/i2FA/mGmCmA/i2FG/mGmUmGmAmGmG*mG*mG | 688 |
| 149 | mC*mUmCmAmCmCmU/i2FG//i2FC//i2FU//i2FU/mAmAmUmUmGmAmCmAmAmGmCmAmGmCmCmG[ademA-GalNAc][ademA-GalNAc][ademA-GalNAc]mGmGmCmUmGmC | 689 | [MePhosphonate-4O-mUs]/i2FU/*/i2FG/*/i2FU//i2FC/mA/i2FA/mUmU/i2FA/mAmGmC/i2FA/mGmGmUmGmAmG*mG*mG | 690 |
| 150 | mU*mCmAmCmCmUmG/i2FC//i2FU//i2FU//i2FA/mAmUmUmGmAmCmAmCmAmGmCmAmGmCmCmG[ademA-GalNAc][ademA-GalNAc][ademA-GalNAc]mGmGmCmUmGmC | 691 | [MePhosphonate-4O-mUs]/i2FG/*/i2FU/*/i2FG//i2FU/mC/i2FA/mAmU/i2FU/mAmAmG/i2FC/mAmGmGmUmGmA*mG*mG | 692 |
| 151 | mC*mAmCmCmUmGmC/i2FU//i2FU//i2FA//i2FA/mUmUmGmAmCmAmCmCmAmGmCmAmGmCmCmG[ademA-GalNAc][ademA-GalNAc][ademA-GalNAc]mGmGmCmUmGmC | 693 | [MePhosphonate-4O-mUs]/i2FG/*/i2FG/*/i2FU//i2FG/mU/i2FC/mAmA/i2FU/mUmAmA/i2FG/mCmAmGmGmUmG*mG*mG | 694 |
| 152 | mA*mCmCmUmGmCmU/i2FU//i2FA//i2FA//i2FU/mUmGmAmCmAmCmCmAmAmGmCmAmGmCmCmG[ademA-GalNAc][ademA-GalNAc][ademA-GalNAc]mGmGmCmUmGmC | 695 | [MePhosphonate-4O-mUs]/i2FU/*/i2FG/*/i2FG//i2FU/mG/i2FU/mCmA/i2FA/mUmUmA/i2FA/mGmCmAmGmGmU*mG*mG | 696 |
| 153 | mC*mCmUmGmCmUmU/i2FA//i2FA//i2FU//i2FU/mGmAmCmAmCmCmAmAmAmGmCmAmGmCmCmG[ademA-GalNAc][ademA-GalNAc][ademA-GalNAc]mGmGmCmUmGmC | 697 | [MePhosphonate-4O-mUs]/i2FU/*/i2FU/*/i2FG//i2FG/mU/i2FG/mUmC/i2FA/mAmUmU/i2FA/mAmGmCmAmGmG*mG*mG | 698 |
| 154 | mC*mUmGmCmUmUmA/i2FA//i2FU//i2FU//i2FG/mAmCmAmCmCmAmAmCmAmGmCmAmGmCmCmG[ademA-GalNAc][ademA-GalNAc][ademA-GalNAc]mGmGmCmUmGmC | 699 | [MePhosphonate-4O-mUs]/i2FG/*/i2FU/*/i2FU//i2FG/mG/i2FU/mGmU/i2FC/mAmAmU/i2FU/mAmAmGmCmAmG*mG*mG | 700 |

-continued

SEQ ID NOs: 393-776 - GalXC™-SCAP Oligonucleotides (modified)

| GalXC-SCAP Oligo | Sense Strand (passenger; 36-mer) | SEQ ID NO: | Antisense Strand (guide; 22-mer) | SEQ ID NO: |
|---|---|---|---|---|
| 155 | mU*mGmCmUmUmAmA/i2FU//i2FU//i2FG//i2FA/mCmAmCmCmAmAmCmUmAmGmCmAmGmCmCmG[ademA-GalNAc][ademA-GalNAc][ademA-GalNAc]mGmGmCmUmGmC | 701 | [MePhosphonate-4O-mUs]/i2FA/*/i2FG/*/i2FU//i2FU/mG/i2FG/mUmG/i2FU/mCmAmA/i2FU/mUmAmAmGmCmA*mG*mG | 702 |
| 156 | mG*mCmUmUmAmAmU/i2FU//i2FG//i2FA//i2FC/mAmCmCmAmAmCmUmUmAmGmCmAmGmCmCmG[ademA-GalNAc][ademA-GalNAc][ademA-GalNAc]mGmGmCmUmGmC | 703 | [MePhosphonate-4O-mUs]/i2FA/*/i2FA/*/i2FG//i2FU/mU/i2FG/mGmU/i2FG/mUmCmA/i2FA/mUmUmAmAmGmC*mG*mG | 704 |
| 157 | mC*mUmUmAmAmUmU/i2FG//i2FA//i2FC//i2FA/mCmCmAmAmCmUmUmUmAmGmCmAmGmCmCmG[ademA-GalNAc][ademA-GalNAc][ademA-GalNAc]mGmGmCmUmGmC | 705 | [MePhosphonate-4O-mUs]/i2FA/*/i2FA/*/i2FA//i2FG/mU/i2FU/mGmG/i2FU/mGmUmC/i2FA/mAmUmUmAmAmG*mG*mG | 706 |
| 158 | mU*mUmAmAmUmUmG/i2FA//i2FC//i2FA//i2FC/mCmAmAmCmUmUmUmUmAmGmCmAmGmCmCmG[ademA-GalNAc][ademA-GalNAc][ademA-GalNAc]mGmGmCmUmGmC | 707 | [MePhosphonate-4O-mUs]/i2FA/*/i2FA/*/i2FA//i2FA/mG/i2FU/mUmG/i2FG/mUmGmU/i2FC/mAmAmUmUmAmA*mG*mG | 708 |
| 159 | mU*mAmAmUmUmGmA/i2FC//i2FA//i2FC//i2FC/mAmAmCmUmUmUmUmCmAmGmCmAmGmCmCmG[ademA-GalNAc][ademA-GalNAc][ademA-GalNAc]mGmGmCmUmGmC | 709 | [MePhosphonate-4O-mUs]/i2FG/*/i2FA/*/i2FA//i2FA/mA/i2FG/mUmU/i2FG/mGmUmG/i2FU/mCmAmAmUmUmA*mG*mG | 710 |
| 160 | mA*mUmUmGmAmAmG/i2FG//i2FG//i2FG//i2FU/mGmCmUmGmUmGmCmUmAmGmCmAmGmCmCmG[ademA-GalNAc][ademA-GalNAc][ademA-GalNAc]mGmGmCmUmGmC | 711 | [MePhosphonate-4O-mUs]/i2FA/*/i2FG/*/i2FC//i2FA/mC/i2FA/mGmC/i2FA/mCmCmC/i2FC/mUmUmCmAmAmU*mG*mG | 712 |
| 161 | mC*mUmUmGmGmAmC/i2FA//i2FA//i2FA//i2FA/mGmGmAmUmUmGmUmGmAmGmCmAmGmCmCmG[ademA-GalNAc][ademA-GalNAc][ademA-GalNAc]mGmGmCmUmGmC | 713 | [MePhosphonate-4O-mUs]/i2FC/*/i2FA/*/i2FC//i2FA/mA/i2FU/mCmC/i2FU/mUmUmU/i2FG/mUmCmCmAmAmG*mG*mG | 714 |
| 162 | mU*mUmGmGmAmCmA/i2FA//i2FA//i2FA//i2FG/mGmAmUmUmGmUmGmGmAmGmCmAmGmCmCmG[ademA-GalNAc][ademA-GalNAc][ademA-GalNAc]mGmGmCmUmGmC | 715 | [MePhosphonate-4O-mUs]/i2FC/*/i2FC/*/i2FA//i2FC/mA/i2FA/mUmC/i2FC/mUmUmU/i2FU/mGmUmCmCmAmA*mG*mG | 716 |
| 163 | mU*mCmAmAmCmGmG/i2FU//i2FU//i2FC//i2FC/mCmUmUmGmAmUmUmUmAmGmCmAmGmCmCmG[ademA-GalNAc][ademA-GalNAc][ademA-GalNAc]mGmGmCmUmGmC | 717 | [MePhosphonate-4O-mUs]/i2FA/*/i2FA/*/i2FA//i2FU/mC/i2FA/mAmG/i2FG/mGmAmA/i2FC/mCmGmUmUmGmA*mG*mG | 718 |
| 164 | mC*mAmAmCmGmGmU/i2FU//i2FC//i2FC//i2FC/mUmUmGmAmUmUmCmAmGmCmAmGmCmCmG[ademA-GalNAc][ademA-GalNAc][ademA-GalNAc]mGmGmCmUmGmC | 719 | [MePhosphonate-4O-mUs]/i2FG/*/i2FA/*/i2FA//i2FA/mU/i2FC/mAmA/i2FG/mGmGmA/i2FA/mCmCmGmUmUmG*mG*mG | 720 |
| 165 | mA*mAmCmGmGmUmU/i2FC//i2FC//i2FC//i2FU/mUmGmAmUmUmUmCmUmAmGmCmAmGmCmCmG[ademA-GalNAc][ademA-GalNAc][ademA-GalNAc]mGmGmCmUmGmC | 721 | [MePhosphonate-4O-mUs]/i2FA/*/i2FG/*/i2FA//i2FA/mA/i2FU/mCmA/i2FA/mGmGmG/i2FA/mAmCmCmGmUmUmG*mG | 722 |
| 166 | mA*mCmGmGmUmUmC/i2FC//i2FC//i2FU//i2FU/mGmAmUmUmUmCmUmUmAmGmCmAmGmCmCmG[ademA-GalNAc][ademA-GalNAc][ademA-GalNAc]mGmGmCmUmGmC | 723 | [MePhosphonate-4O-mUs]/i2FA/*/i2FA/*/i2FG//i2FA/mA/i2FA/mUmC/i2FA/mAmGmG/i2FG/mAmAmCmCmGmU*mG*mG | 724 |

-continued

| SEQ ID NOs: 393-776 - GalXC™-SCAP Oligonucleotides (modified) | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 167 | mG*mUmAmCmAmUmU/i2FG//i2FA//i2FC//i2FC/mAmGmAmCmCmAmUmGmAmGmCmAmGmCmCmG[ademA-GalNAc][ademA-GalNAc][ademA-GalNAc]mGmGmCmUmGmC | 725 | [MePhosphonate-4O-mUs]/i2FC/*/i2FA/*/i2FU//i2FG/mG/i2FU/mCmU/i2FG/mGmUmC/i2FA/mAmUmGmUmAmC*mG*mG | 726 |
| 168 | mA*mCmCmUmGmUmA/i2FC//i2FC//i2FA//i2FC/mCmUmCmCmUmGmUmGmAmGmCmAmGmCmCmG[ademA-GalNAc][ademA-GalNAc][ademA-GalNAc]mGmGmCmUmGmC | 727 | [MePhosphonate-4O-mUs]/i2FC/*/i2FA/*/i2FC//i2FA/mG/i2FG/mAmG/i2FG/mUmGmG/i2FU/mAmCmAmGmGmU*mG*mG | 728 |
| 169 | mC*mCmUmGmUmAmC/i2FC//i2FA//i2FC//i2FC/mUmCmCmUmGmUmGmUmAmGmCmAmGmCmCmG[ademA-GalNAc][ademA-GalNAc][ademA-GalNAc]mGmGmCmUmGmC | 729 | [MePhosphonate-4O-mUs]/i2FA/*/i2FC/*/i2FA//i2FC/mA/i2FG/mGmA/i2FG/mGmUmG/i2FG/mUmAmCmAmGmG*mG*mG | 730 |
| 170 | mG*mUmAmCmCmAmC/i2FC//i2FU//i2FC//i2FC/mUmGmUmGmUmCmAmUmAmGmCmAmGmCmCmG[ademA-GalNAc][ademA-GalNAc][ademA-GalNAc]mGmGmCmUmGmC | 731 | [MePhosphonate-4O-mUs]/i2FA/*/i2FU/*/i2FG//i2FA/mC/i2FA/mCmA/i2FG/mGmAmG/i2FG/mUmGmGmUmAmC*mG*mG | 732 |
| 171 | mG*mCmAmCmAmGmG/i2FC//i2FA//i2FU//i2FC/mAmAmGmUmUmCmUmAmAmGmCmAmGmCmCmG[ademA-GalNAc][ademA-GalNAc][ademA-GalNAc]mGmGmCmUmGmC | 733 | [MePhosphonate-4O-mUs]/i2FU/*/i2FA/*/i2FG//i2FA/mA/i2FC/mUmU/i2FG/mAmUmG/i2FC/mCmUmGmUmGmC*mG*mG | 734 |
| 172 | mA*mCmAmGmGmCmA/i2FU//i2FC//i2FA//i2FA/mGmUmUmCmUmAmCmUmAmGmCmAmGmCmCmG[ademA-GalNAc][ademA-GalNAc][ademA-GalNAc]mGmGmCmUmGmC | 735 | [MePhosphonate-4O-mUs]/i2FA/*/i2FG/*/i2FU//i2FA/mG/i2FA/mAmC/i2FU/mUmGmA/i2FU/mGmCmCmUmGmU*mG*mG | 736 |
| 173 | mC*mAmGmGmCmAmU/i2FC//i2FA//i2FA//i2FG/mUmUmCmUmAmCmUmCmAmGmCmAmGmCmCmG[ademA-GalNAc][ademA-GalNAc][ademA-GalNAc]mGmGmCmUmGmC | 737 | [MePhosphonate-4O-mUs]/i2FG/*/i2FA/*/i2FG//i2FU/mA/i2FG/mAmA/i2FC/mUmUmG/i2FA/mUmGmCmCmUmG*mG*mG | 738 |
| 174 | mA*mGmGmCmAmUmC/i2FA//i2FA//i2FG//i2FU/mUmCmUmAmCmUmCmCmAmGmCmAmGmCmCmG[ademA-GalNAc][ademA-GalNAc][ademA-GalNAc]mGmGmCmUmGmC | 739 | [MePhosphonate-4O-mUs]/i2FG/*/i2FG/*/i2FA//i2FG/mU/i2FA/mGmA/i2FA/mCmUmU/i2FG/mAmUmGmCmCmU*mG*mG | 740 |
| 175 | mG*mGmCmAmUmCmA/i2FA//i2FG//i2FU//i2FU/mCmUmAmCmUmCmCmAmAmGmCmAmGmCmCmG[ademA-GalNAc][ademA-GalNAc][ademA-GalNAc]mGmGmCmUmGmC | 741 | [MePhosphonate-4O-mUs]/i2FU/*/i2FG/*/i2FG//i2FA/mG/i2FU/mAmG/i2FA/mAmCmU/i2FU/mGmAmUmGmCmC*mG*mG | 742 |
| 176 | mG*mCmAmUmCmAmA/i2FG//i2FU//i2FU//i2FC/mUmAmCmUmCmCmAmUmAmGmCmAmGmCmCmG[ademA-GalNAc][ademA-GalNAc][ademA-GalNAc]mGmGmCmUmGmC | 743 | [MePhosphonate-4O-mUs]/i2FA/*/i2FU/*/i2FG//i2FG/mA/i2FG/mUmA/i2FG/mAmAmC/i2FU/mUmGmAmUmGmC*mG*mG | 744 |
| 177 | mC*mAmUmCmAmAmG/i2FU//i2FU//i2FC//i2FU/mAmCmUmCmCmAmUmUmAmGmCmAmGmCmCmG[ademA-GalNAc][ademA-GalNAc][ademA-GalNAc]mGmGmCmUmGmC | 745 | [MePhosphonate-4O-mUs]/i2FA/*/i2FA/*/i2FU//i2FG/mG/i2FA/mGmU/i2FA/mGmAmA/i2FC/mUmUmGmAmUmG*mG*mG | 746 |
| 178 | mA*mUmCmAmAmGmU/i2FU//i2FC//i2FU//i2FA/mCmUmCmCmAmUmUmCmAmGmCmAmGmCmCmG[ademA-GalNAc][ademA-GalNAc][ademA-GalNAc]mGmGmCmUmGmC | 747 | [MePhosphonate-4O-mUs]/i2FG/*/i2FA/*/i2FA//i2FU/mG/i2FG/mAmG/i2FU/mAmGmA/i2FA/mCmUmUmGmAmU*mG*mG | 748 |

-continued

| SEQ ID NOs: 393-776 - GalXC ™-SCAP Oligonucleotides (modified) | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 179 | mU*mCmAmAmGmUmU/i2FC//i2FU//i2FA//i2FC/mUmCmCmAmUmUmCmAmAmGmCmAmGmCmCmG[ademA-GalNAc][ademA-GalNAc][ademA-GalNAc]mGmGmCmUmGmC | 749 | [MePhosphonate-4O-mUs]/i2FU/*/i2FG/*/i2FA//i2FA/mU/i2FG/mGmA/i2FG/mUmAmG/i2FA/mAmCmUmUmGmA*mG*mG | 750 |
| 180 | mC*mAmAmGmUmUmC/i2FU//i2FA//i2FC//i2FU/mCmCmAmUmUmCmAmGmAmGmCmAmGmCmCmG[ademA-GalNAc][ademA-GalNAc][ademA-GalNAc]mGmGmCmUmGmC | 751 | [MePhosphonate-4O-mUs]/i2FC/*/i2FU/*/i2FG//i2FA/mA/i2FU/mGmG/i2FA/mGmUmA/i2FG/mAmAmCmUmUmG*mG*mG | 752 |
| 181 | mA*mAmGmUmUmCmU/i2FA//i2FC//i2FU//i2FC/mCmAmUmUmCmAmGmCmAmGmCmAmGmCmCmG[ademA-GalNAc][ademA-GalNAc][ademA-GalNAc]mGmGmCmUmGmC | 753 | [MePhosphonate-4O-mUs]/i2FG/*/i2FC/*/i2FU//i2FG/mA/i2FA/mUmG/i2FG/mAmGmU/i2FA/mGmAmAmCmUmU*mG*mG | 754 |
| 182 | mA*mGmUmUmCmUmA/i2FC//i2FU//i2FC//i2FC/mAmUmUmCmAmGmCmAmAmGmCmAmGmCmCmG[ademA-GalNAc][ademA-GalNAc][ademA-GalNAc]mGmGmCmUmGmC | 755 | [MePhosphonate-4O-mUs]/i2FU/*/i2FG/*/i2FC//i2FU/mG/i2FA/mAmU/i2FG/mGmAmG/i2FU/mAmGmAmAmCmU*mG*mG | 756 |
| 183 | mG*mUmUmCmUmAmC/i2FU//i2FC//i2FC//i2FA/mUmUmCmAmGmCmAmGmAmGmCmAmGmCmCmG[ademA-GalNAc][ademA-GalNAc][ademA-GalNAc]mGmGmCmUmGmC | 757 | [MePhosphonate-4O-mUs]/i2FC/*/i2FU/*/i2FG//i2FC/mU/i2FG/mAmA/i2FU/mGmGmA/i2FG/mUmAmGmAmAmC*mG*mG | 758 |
| 184 | mG*mUmGmUmCmAmU/i2FC//i2FU//i2FC//i2FA/mGmAmCmAmAmCmCmUmAmGmCmAmGmCmCmG[ademA-GalNAc][ademA-GalNAc][ademA-GalNAc]mGmGmCmUmGmC | 759 | [MePhosphonate-4O-mUs]/i2FA/*/i2FG/*/i2FG//i2FU/mU/i2FG/mUmC/i2FU/mGmAmG/i2FA/mUmGmAmCmAmC*mG*mG | 760 |
| 185 | mC*mAmUmCmUmCmA/i2FG//i2FA//i2FC//i2FA/mAmCmCmUmGmCmUmGmAmGmCmAmGmCmCmG[ademA-GalNAc][ademA-GalNAc][ademA-GalNAc]mGmGmCmUmGmC | 761 | [MePhosphonate-4O-mUs]/i2FC/*/i2FA/*/i2FG//i2FC/mA/i2FG/mGmU/i2FU/mGmUmC/i2FU/mGmAmGmAmUmG*mG*mG | 762 |
| 186 | mU*mCmAmGmAmCmA/i2FA//i2FC//i2FC//i2FU/mGmCmUmGmGmUmGmAmAmGmCmAmGmCmCmG[ademA-GalNAc][ademA-GalNAc][ademA-GalNAc]mGmGmCmUmGmC | 763 | [MePhosphonate-4O-mUs]/i2FU/*/i2FC/*/i2FA//i2FC/mC/i2FA/mGmC/i2FA/mGmGmU/i2FU/mGmUmCmUmGmA*mG*mG | 764 |
| 187 | mC*mGmGmGmGmAmC/i2FC//i2FU//i2FG//i2FU/mUmAmCmAmGmAmCmAmAmGmCmAmGmCmCmG[ademA-GalNAc][ademA-GalNAc][ademA-GalNAc]mGmGmCmUmGmC | 765 | [MePhosphonate-4O-mUs]/i2FU/*/i2FG/*/i2FU//i2FC/mU/i2FG/mUmA/i2FA/mCmAmG/i2FG/mUmCmCmCmCmG*mG*mG | 766 |
| 188 | mG*mAmCmAmAmCmG/i2FC//i2FU//i2FG//i2FC/mCmAmUmUmGmUmCmUmAmGmCmAmGmCmCmG[ademA-GalNAc][ademA-GalNAc][ademA-GalNAc]mGmGmCmUmGmC | 767 | [MePhosphonate-4O-mUs]/i2FA/*/i2FG/*/i2FA//i2FC/mA/i2FA/mUmG/i2FG/mCmAmG/i2FC/mGmUmUmGmUmC*mG*mG | 768 |
| 189 | mG*mCmUmGmCmCmU/i2FC//i2FC//i2FU//i2FG/mAmCmUmGmUmAmAmUmAmGmCmAmGmCmCmG[ademA-GalNAc][ademA-GalNAc][ademA-GalNAc]mGmGmCmUmGmC | 769 | [MePhosphonate-4O-mUs]/i2FA/*/i2FU/*/i2FU//i2FA/mC/i2FA/mGmU/i2FC/mAmGmG/i2FA/mGmGmCmAmGmC*mG*mG | 770 |
| 190 | mC*mUmGmCmCmUmC/i2FC//i2FU//i2FG//i2FA/mCmUmGmUmAmAmUmAmAmGmCmAmGmCmCmG[ademA-GalNAc][ademA-GalNAc][ademA-GalNAc]mGmGmCmUmGmC | 771 | [MePhosphonate-4O-mUs]/i2FU/*/i2FA/*/i2FU//i2FU/mA/i2FC/mAmG/i2FU/mCmAmG/i2FG/mAmGmGmCmAmG*mG*mG | 772 |

-continued

| SEQ ID NOs: 393-776 - GalXC™-SCAP Oligonucleotides (modified) | | | | |
|---|---|---|---|---|
| GalXC-SCAP Oligo | Sense Strand (passenger; 36-mer) | SEQ ID NO: | Antisense Strand (guide; 22-mer) | SEQ ID NO: |
| 191 | mU*mAmAmUmAmUmU/ i2FA//i2FA//i2FA//i2FC/ mUmUmUmUmUmUmAmAmAmGmCmAmGmCmCmG[ademA-GalNAc][ademA-GalNAc][ademA-GalNAc]mGmGmCmUmGmC | 773 | [MePhosphonate-4O-mUs]/i2FU/*/i2FU/*/i2FA//i2FA/ mA/i2FA/mAmA/i2FG/ mUmUmU/i2FA/ mAmUmAmUmUmA*mG*mG | 774 |
| 192 | mA*mAmUmAmUmUmA/ i2FA//i2FA//i2FC//i2FU/ mUmUmUmUmUmAmAmAmAmGmCmAmGmCmCmG[ademA-GalNAc][ademA-GalNAc][ademA-GalNAc]mGmGmCmUmGmC | 775 | [MePhosphonate-4O-mUs]/i2FU/*/i2FU/*/i2FU//i2FA/ mA/i2FA/mAmA/i2FA/ mGmUmU/i2FU/ mAmAmUmAmUmU*mG*mG | 776 |

Target Sequence 1 SEQ ID NO: 777
ACATCATCTTGTTTGCCTA

Target Sequence 2 SEQ ID NO: 778
TCTTGTTTGCCTACATCTA

Target Sequence 3 SEQ ID NO: 779
CTTCAGATGCTGTTTTTCA

Target Sequence 4 SEQ ID NO: 780
CGCTCTTCAGCTATTACAA

Target Sequence 5 SEQ ID NO: 781
CTTAATTGACACCAACTTT

Target Sequence 6 SEQ ID NO: 782
TCAACGGTTCCCTTGATTT

Target Sequence 7 SEQ ID NO: 783
CATCAAGTTCTACTCCATT

Artificial Sequence SEQ ID NO: 784
GCAGCCGAAAGGCUGC

| SEQ ID NOs: 785-1168-SCAP Oligonucleotides | | | | |
|---|---|---|---|---|
| SCAP Oligo | Sense Strand (passenger; 19-mer) | SEQ ID NO: | Antisense Strand (guide; 19-mer) | SEQ ID NO: |
| 1 | UGUUUGCCUACAUC UACUU | 785 | AAGUAGAUGUAGGCAA ACA | 786 |
| 2 | GUUUGCCUACAUCU ACUUC | 787 | GAAGUAGAUGUAGGCA AAC | 788 |
| 3 | UUUGCCUACAUCUA CUUCU | 789 | AGAAGUAGAUGUAGGC AAA | 790 |
| 4 | GCCUACAUCUACUU CUCCA | 791 | UGGAGAAGUAGAUGUA GGC | 792 |
| 5 | AAGAUCGACAUGGU CAAGU | 793 | ACUUGACCAUGUCGAU CUU | 794 |
| 6 | AGAUCGACAUGGUC AAGUC | 795 | GACUUGACCAUGUCGA UCU | 796 |

-continued

| SEQ ID NOs: 785-1168-SCAP Oligonucleotides | | | | |
|---|---|---|---|---|
| SCAP Oligo | Sense Strand (passenger; 19-mer) | SEQ ID NO: | Antisense Strand (guide; 19-mer) | SEQ ID NO: |
| 7 | AUCGACAUGGUCAA GUCCA | 797 | UGGACUUGACCAUGUC GAU | 798 |
| 8 | GUGUUGGUGCUCAC CAAGU | 799 | ACUUGGUGAGCACCAA CAC | 800 |
| 9 | UGUUGGUGCUCACC AAGUC | 801 | GACUUGGUGAGCACCA ACA | 802 |
| 10 | GAGAGCUGGUCCAU CAUGA | 803 | UCAUGAUGGACCAGCU CUC | 804 |
| 11 | AGAGCUGGUCCAUC AUGAA | 805 | UUCAUGAUGGACCAGC UCU | 806 |
| 12 | GAGCUGGUCCAUCA UGAAG | 807 | CUUCAUGAUGGACCAG CUC | 808 |
| 13 | AGCUGGUCCAUCAU GAAGA | 809 | UCUUCAUGAUGGACCA GCU | 810 |
| 14 | GCUGGUCCAUCAUG AAGAA | 811 | UUCUUCAUGAUGGACC AGC | 812 |
| 15 | CUGGUCCAUCAUGA AGAAC | 813 | GUUCUUCAUGAUGGAC CAG | 814 |
| 16 | CCGUUGUCUGGAUU GGCAU | 815 | AUGCCAAUCCAGACAA CGG | 816 |
| 17 | UUGUCUGGAUUGGC AUCCU | 817 | AGGAUGCCAAUCCAGA CAA | 818 |
| 18 | UGUCUGGAUUGGCA UCCUG | 819 | CAGGAUGCCAAUCCAG ACA | 820 |
| 19 | GUCUGGAUUGGCAU CCUGG | 821 | CCAGGAUGCCAAUCCA GAC | 822 |
| 20 | CUGGAUUGGCAUCC UGGUA | 823 | UACCAGGAUGCCAAUC CAG | 824 |
| 21 | UGGAUUGGCAUCCU GGUAU | 825 | AUACCAGGAUGCCAAU CCA | 826 |
| 22 | GGAUUGGCAUCCUG GUAUA | 827 | UAUACCAGGAUGCCAA UCC | 828 |

-continued

SEQ ID NOs: 785-1168-SCAP Oligonucleotides

| SCAP Oligo | Sense Strand (passenger; 19-mer) | SEQ ID NO: | Antisense Strand (guide; 19-mer) | SEQ ID NO: |
|---|---|---|---|---|
| 23 | GAUUGGCAUCCUGGUAUAC | 829 | GUAUACCAGGAUGCCAAUC | 830 |
| 24 | AUUGGCAUCCUGGUAUACA | 831 | UGUAUACCAGGAUGCCAAU | 832 |
| 25 | CUCCAUCUUCCCACCUGAU | 833 | AUCAGGUGGGAAGAUGGAG | 834 |
| 26 | CAUCUGCCUGUGGGAUGUA | 835 | UACAUCCCACAGGCAGAUG | 836 |
| 27 | UCUGCCUGUGGGAUGUACU | 837 | AGUACAUCCCACAGGCAGA | 838 |
| 28 | GUGGUGCAAGCUUGGGUGU | 839 | ACACCCAAGCUUGCACCAC | 840 |
| 29 | UGGUGCAAGCUUGGGUGUC | 841 | GACACCCAAGCUUGCACCA | 842 |
| 30 | GGUGCAAGCUUGGGUGUCA | 843 | UGACACCCAAGCUUGCACC | 844 |
| 31 | GUGCAAGCUUGGGUGUCAU | 845 | AUGACACCCAAGCUUGCAC | 846 |
| 32 | GCAAGCUUGGGUGUCAUCU | 847 | AGAUGACACCCAAGCUUGC | 848 |
| 33 | CAAGCUUGGGUGUCAUCUC | 849 | GAGAUGACACCCAAGCUUG | 850 |
| 34 | AAGCUUGGGUGUCAUCUCA | 851 | UGAGAUGACACCCAAGCUU | 852 |
| 35 | AGCUUGGGUGUCAUCUCAG | 853 | CUGAGAUGACACCCAAGCU | 854 |
| 36 | GCUUGGGUGUCAUCUCAGA | 855 | UCUGAGAUGACACCCAAGC | 856 |
| 37 | GUGUCUCCUUUUGGGACCU | 857 | AGGUCCCAAAAGGAGACAC | 858 |
| 38 | UGUCUCCUUUUGGGACCUA | 859 | UAGGUCCCAAAAGGAGACA | 860 |
| 39 | GGGGACCUGUUACAGACAG | 861 | CUGUCUGUAACAGGUCCCC | 862 |
| 40 | GGGACCUGUUACAGACAGU | 863 | ACUGUCUGUAACAGGUCCC | 864 |
| 41 | GGACCUGUUACAGACAGUC | 865 | GACUGUCUGUAACAGGUCC | 866 |
| 42 | GACCUGUUACAGACAGUCU | 867 | AGACUGUCUGUAACAGGUC | 868 |
| 43 | ACCUGUUACAGACAGUCUA | 869 | UAGACUGUCUGUAACAGGU | 870 |
| 44 | UGCCAUUGUCUGCAACUUU | 871 | AAAGUUGCAGACAAUGGCA | 872 |
| 45 | GCCAUUGUCUGCAACUUUG | 873 | CAAAGUUGCAGACAAUGGC | 874 |
| 46 | CCAUUGUCUGCAACUUUGG | 875 | CCAAAGUUGCAGACAAUGG | 876 |

-continued

SEQ ID NOs: 785-1168-SCAP Oligonucleotides

| SCAP Oligo | Sense Strand (passenger; 19-mer) | SEQ ID NO: | Antisense Strand (guide; 19-mer) | SEQ ID NO: |
|---|---|---|---|---|
| 47 | AUUGUCUGCAACUUUGGCA | 877 | UGCCAAAGUUGCAGACAAU | 878 |
| 48 | UCUGCAACUUUGGCAGUGA | 879 | UCACUGCCAAAGUUGCAGA | 880 |
| 49 | CUACCCACUGCUGAAACUC | 881 | GAGUUUCAGCAGUGGGUAG | 882 |
| 50 | GCCAGGAACAGGACCUGUG | 883 | CACAGGUCCUGUUCCUGGC | 884 |
| 51 | GAACAGGACCUGUGGAAUU | 885 | AAUUCCACAGGUCCUGUUC | 886 |
| 52 | ACAGGACCUGUGGAAUUCA | 887 | UGAAUUCCACAGGUCCUGU | 888 |
| 53 | UGGAAUUCACCACCCCUGU | 889 | ACAGGGGUGGUGAAUUCCA | 890 |
| 54 | CUUGUGACCACCUACAUCA | 891 | UGAUGUAGGUGGUCACAAG | 892 |
| 55 | UUGUGACCACCUACAUCAU | 893 | AUGAUGUAGGUGGUCACAA | 894 |
| 56 | UGUGACCACCUACAUCAUC | 895 | GAUGAUGUAGGUGGUCACA | 896 |
| 57 | GUGACCACCUACAUCAUCU | 897 | AGAUGAUGUAGGUGGUCAC | 898 |
| 58 | UGACCACCUACAUCAUCUU | 899 | AAGAUGAUGUAGGUGGUCA | 900 |
| 59 | GACCACCUACAUCAUCUUG | 901 | CAAGAUGAUGUAGGUGGUC | 902 |
| 60 | ACCACCUACAUCAUCUUGU | 903 | ACAAGAUGAUGUAGGUGGU | 904 |
| 61 | CCACCUACAUCAUCUUGUU | 905 | AACAAGAUGAUGUAGGUGG | 906 |
| 62 | CACCUACAUCAUCUUGUUU | 907 | AAACAAGAUGAUGUAGGUG | 908 |
| 63 | ACCUACAUCAUCUUGUUUG | 909 | CAAACAAGAUGAUGUAGGU | 910 |
| 64 | CCUACAUCAUCUUGUUUGC | 911 | GCAAACAAGAUGAUGUAGG | 912 |
| 65 | CUACAUCAUCUUGUUUGCC | 913 | GGCAAACAAGAUGAUGUAG | 914 |
| 66 | ACAUCAUCUUGUUUGCCUA | 915 | UAGGCAAACAAGAUGAUGU | 916 |
| 67 | AUCAUCUUGUUUGCCUACA | 917 | UGUAGGCAAACAAGAUGAU | 918 |
| 68 | UCAUCUUGUUUGCCUACAU | 919 | AUGUAGGCAAACAAGAUGA | 920 |
| 69 | AUCUUGUUUGCCUACAUCU | 921 | AGAUGUAGGCAAACAAGAU | 922 |
| 70 | UCUUGUUUGCCUACAUCUA | 923 | UAGAUGUAGGCAAACAAGA | 924 |
| 71 | UUUCCCCUACCUUGUGGUG | 925 | CACCACAAGGUAGGGGAAA | 926 |

-continued

SEQ ID NOs: 785-1168-SCAP Oligonucleotides

| SCAP Oligo | Sense Strand (passenger; 19-mer) | SEQ ID NO: | Antisense Strand (guide; 19-mer) | SEQ ID NO: |
|---|---|---|---|---|
| 72 | UUCCCCUACCUUGUGGUGG | 927 | CCACCACAAGGUAGGGAA | 928 |
| 73 | CCCUACCUUGUGGUGGUUA | 929 | UAACCACCACAAGGUAGGG | 930 |
| 74 | CUACCUUGUGGUGGUUAUU | 931 | AAUAACCACCACAAGGUAG | 932 |
| 75 | UACCUUGUGGUGGUUAUUG | 933 | CAAUAACCACCACAAGGUA | 934 |
| 76 | ACCUUGUGGUGGUUAUUGG | 935 | CCAAUAACCACCACAAGGU | 936 |
| 77 | CCUUGUGGUGGUUAUUGGG | 937 | CCCAAUAACCACCACAAGG | 938 |
| 78 | CUUGUGGUGGUUAUUGGGU | 939 | ACCCAAUAACCACCACAAG | 940 |
| 79 | UUGUGGUGGUUAUUGGGUU | 941 | AACCCAAUAACCACCACAA | 942 |
| 80 | UGUGGUGGUUAUUGGGUUA | 943 | UAACCCAAUAACCACCACA | 944 |
| 81 | GUGGUGGUUAUUGGGUUAG | 945 | CUAACCCAAUAACCACCAC | 946 |
| 82 | UGGUGGUUAUUGGGUUAGA | 947 | UCUAACCCAAUAACCACCA | 948 |
| 83 | GGUGGUUAUUGGGUUAGAG | 949 | CUCUAACCCAAUAACCACC | 950 |
| 84 | GUGGUUAUUGGGUUAGAGA | 951 | UCUCUAACCCAAUAACCAC | 952 |
| 85 | UGGUUAUUGGGUUAGAGAA | 953 | UUCUCUAACCCAAUAACCA | 954 |
| 86 | GGUUAUUGGGUUAGAGAAU | 955 | AUUCUCUAACCCAAUAACC | 956 |
| 87 | GUUAUUGGGUUAGAGAAUG | 957 | CAUUCUCUAACCCAAUAAC | 958 |
| 88 | UUAUUGGGUUAGAGAAUGU | 959 | ACAUUCUCUAACCCAAUAA | 960 |
| 89 | AUUGGGUUAGAGAAUGUGU | 961 | ACACAUUCUCUAACCCAAU | 962 |
| 90 | UUGGGUUAGAGAAUGUGUU | 963 | AACACAUUCUCUAACCCAA | 964 |
| 91 | GGUUAGAGAAUGUGUUGGU | 965 | ACCAACACAUUCUCUAACC | 966 |
| 92 | GUUAGAGAAUGUGUUGGUG | 967 | CACCAACACAUUCUCUAAC | 968 |
| 93 | UUAGAGAAUGUGUUGGUGC | 969 | GCACCAACACAUUCUCUAA | 970 |
| 94 | UAGAGAAUGUGUUGGUGCU | 971 | AGCACCAACACAUUCUCUA | 972 |
| 95 | AGAGAAUGUGUUGGUGCUC | 973 | GAGCACCAACACAUUCUCU | 974 |

-continued

SEQ ID NOs: 785-1168-SCAP Oligonucleotides

| SCAP Oligo | Sense Strand (passenger; 19-mer) | SEQ ID NO: | Antisense Strand (guide; 19-mer) | SEQ ID NO: |
|---|---|---|---|---|
| 96 | GAGAAUGUGUUGGUGCUCA | 975 | UGAGCACCAACACAUUCUC | 976 |
| 97 | AGAAUGUGUUGGUGCUCAC | 977 | GUGAGCACCAACACAUUCU | 978 |
| 98 | AAUGUGUUGGUGCUCACCA | 979 | UGGUGAGCACCAACACAUU | 980 |
| 99 | AUGUGUUGGUGCUCACCAA | 981 | UUGGUGAGCACCAACACAU | 982 |
| 100 | UGUGUUGGUGCUCACCAAG | 983 | CUUGGUGAGCACCAACACA | 984 |
| 101 | UGGUCCAUCAUGAAGAACA | 985 | UGUUCUUCAUGAUGGACCA | 986 |
| 102 | GGUCCAUCAUGAAGAACAU | 987 | AUGUUCUUCAUGAUGGACC | 988 |
| 103 | CUGACUUCUUCCUUCAGAU | 989 | AUCUGAAGGAAGAAGUCAG | 990 |
| 104 | ACUUCUUCCUUCAGAUGCU | 991 | AGCAUCUGAAGGAAGAAGU | 992 |
| 105 | UCCUUCAGAUGCUGUUUUU | 993 | AAAAACAGCAUCUGAAGGA | 994 |
| 106 | CCUUCAGAUGCUGUUUUUC | 995 | GAAAAACAGCAUCUGAAGG | 996 |
| 107 | CUUCAGAUGCUGUUUUUCA | 997 | UGAAAAACAGCAUCUGAAG | 998 |
| 108 | UUCAGAUGCUGUUUUUCAC | 999 | GUGAAAAACAGCAUCUGAA | 1000 |
| 109 | CAGAUGCUGUUUUUCACCA | 1001 | UGGUGAAAAACAGCAUCUG | 1002 |
| 110 | AGAUGCUGUUUUUCACCAC | 1003 | GUGGUGAAAAACAGCAUCU | 1004 |
| 111 | GAUGCUGUUUUUCACCACU | 1005 | AGUGGUGAAAAACAGCAUC | 1006 |
| 112 | AUGCUGUUUUUCACCACUG | 1007 | CAGUGGUGAAAAACAGCAU | 1008 |
| 113 | UGCUGUUUUUCACCACUGU | 1009 | ACAGUGGUGAAAAACAGCA | 1010 |
| 114 | GCUGUUUUUCACCACUGUC | 1011 | GACAGUGGUGAAAAACAGC | 1012 |
| 115 | UGUUUUUCACCACUGUCCU | 1013 | AGGACAGUGGUGAAAAACA | 1014 |
| 116 | GUUUUUCACCACUGUCCUG | 1015 | CAGGACAGUGGUGAAAAAC | 1016 |

-continued

SEQ ID NOs: 785-1168-SCAP Oligonucleotides

| SCAP Oligo | Sense Strand (passenger; 19-mer) | SEQ ID NO: | Antisense Strand (guide; 19-mer) | SEQ ID NO: |
|---|---|---|---|---|
| 117 | UUUUUCACCACUGUCCUGU | 1017 | ACAGGACAGUGGUGAAAAA | 1018 |
| 118 | UUUUCACCACUGUCCUGUC | 1019 | GACAGGACAGUGGUGAAAA | 1020 |
| 119 | UUCACCACUGUCCUGUCCA | 1021 | UGGACAGGACAGUGGUGAA | 1022 |
| 120 | CACCACUGUCCUGUCCAUU | 1023 | AAUGGACAGGACAGUGGUG | 1024 |
| 121 | ACCACUGUCCUGUCCAUUG | 1025 | CAAUGGACAGGACAGUGGU | 1026 |
| 122 | CCACUGUCCUGUCCAUUGA | 1027 | UCAAUGGACAGGACAGUGG | 1028 |
| 123 | CACUGUCCUGUCCAUUGAC | 1029 | GUCAAUGGACAGGACAGUG | 1030 |
| 124 | ACUGUCCUGUCCAUUGACA | 1031 | UGUCAAUGGACAGGACAGU | 1032 |
| 125 | CUAAGCUACCUGAGAACCA | 1033 | UGGUUCUCAGGUAGCUUAG | 1034 |
| 126 | GAGGUCCAGCAGAGGUUGU | 1035 | ACAACCUCUGCUGGACCUC | 1036 |
| 127 | GCAGAGGUUGUCCAUGACA | 1037 | UGUCAUGGACAACCUCUGC | 1038 |
| 128 | CAGAGGUUGUCCAUGACAG | 1039 | CUGUCAUGGACAACCUCUG | 1040 |
| 129 | GAGGAUGAGGAACUUUGGA | 1041 | UCCAAAGUUCCUCAUCCUC | 1042 |
| 130 | GAACUUUGGAGGAAAUUGU | 1043 | ACAAUUUCCUCCAAAGUUC | 1044 |
| 131 | GACGCUCUUCAGCUAUUAC | 1045 | GUAAUAGCUGAAGAGCGUC | 1046 |
| 132 | ACGCUCUUCAGCUAUUACA | 1047 | UGUAAUAGCUGAAGAGCGU | 1048 |
| 133 | CGCUCUUCAGCUAUUACAA | 1049 | UUGUAAUAGCUGAAGAGCG | 1050 |
| 134 | GCUCUUCAGCUAUUACAAC | 1051 | GUUGUAAUAGCUGAAGAGC | 1052 |
| 135 | CUCUUCAGCUAUUACAACA | 1053 | UGUUGUAAUAGCUGAAGAG | 1054 |
| 136 | UCUUCAGCUAUUACAACAU | 1055 | AUGUUGUAAUAGCUGAAGA | 1056 |
| 137 | CUUCAGCUAUUACAACAUC | 1057 | GAUGUUGUAAUAGCUGAAG | 1058 |
| 138 | UUCAGCUAUUACAACAUCA | 1059 | UGAUGUUGUAAUAGCUGAA | 1060 |
| 139 | CCAGCCUGACCUCACCUGC | 1061 | GCAGGUGAGGUCAGGCUGG | 1062 |
| 140 | CAGCCUGACCUCACCUGCU | 1063 | AGCAGGUGAGGUCAGGCUG | 1064 |
| 141 | AGCCUGACCUCACCUGCUU | 1065 | AAGCAGGUGAGGUCAGGCU | 1066 |
| 142 | GCCUGACCUCACCUGCUUA | 1067 | UAAGCAGGUGAGGUCAGGC | 1068 |
| 143 | CCUGACCUCACCUGCUUAA | 1069 | UUAAGCAGGUGAGGUCAGG | 1070 |
| 144 | CUGACCUCACCUGCUUAAU | 1071 | AUUAAGCAGGUGAGGUCAG | 1072 |
| 145 | UGACCUCACCUGCUUAAUU | 1073 | AAUUAAGCAGGUGAGGUCA | 1074 |
| 146 | GACCUCACCUGCUUAAUUG | 1075 | CAAUUAAGCAGGUGAGGUC | 1076 |
| 147 | ACCUCACCUGCUUAAUUGA | 1077 | UCAAUUAAGCAGGUGAGGU | 1078 |
| 148 | CCUCACCUGCUUAAUUGAC | 1079 | GUCAAUUAAGCAGGUGAGG | 1080 |
| 149 | CUCACCUGCUUAAUUGACA | 1081 | UGUCAAUUAAGCAGGUGAG | 1082 |
| 150 | UCACCUGCUUAAUUGACAC | 1083 | GUGUCAAUUAAGCAGGUGA | 1084 |
| 151 | CACCUGCUUAAUUGACACC | 1085 | GGUGUCAAUUAAGCAGGUG | 1086 |
| 152 | ACCUGCUUAAUUGACACCA | 1087 | UGGUGUCAAUUAAGCAGGU | 1088 |
| 153 | CCUGCUUAAUUGACACCAA | 1089 | UUGGUGUCAAUUAAGCAGG | 1090 |
| 154 | CUGCUUAAUUGACACCCAAC | 1091 | GUUGGUGUCAAUUAAGCAG | 1092 |

-continued

SEQ ID NOs: 785-1168-SCAP Oligonucleotides

| SCAP Oligo | Sense Strand (passenger; 19-mer) | SEQ ID NO: | Antisense Strand (guide; 19-mer) | SEQ ID NO: |
|---|---|---|---|---|
| 155 | UGCUUAAUUGACACCAACU | 1093 | AGUUGGUGUCAAUUAAGCA | 1094 |
| 156 | GCUUAAUUGACACCAACUU | 1095 | AAGUUGGUGUCAAUUAAGC | 1096 |
| 157 | CUUAAUUGACACCAACUUU | 1097 | AAAGUUGGUGUCAAUUAAG | 1098 |
| 158 | UUAAUUGACACCAACUUUU | 1099 | AAAAGUUGGUGUCAAUUAA | 1100 |
| 159 | UAAUUGACACCAACUUUUC | 1101 | GAAAAGUUGGUGUCAAUUA | 1102 |
| 160 | AUUGAAGGGGUGCUGUGCU | 1103 | AGCACAGCACCCCUUCAAU | 1104 |
| 161 | CUUGGACAAAAGGAUUGUG | 1105 | CACAAUCCUUUUGUCCAAG | 1106 |
| 162 | UUGGACAAAAGGAUUGUGG | 1107 | CCACAAUCCUUUUGUCCAA | 1108 |
| 163 | UCAACGGUUCCCUUGAUUU | 1109 | AAAUCAAGGGAACCGUUGA | 1110 |
| 164 | CAACGGUUCCCUUGAUUUC | 1111 | GAAAUCAAGGGAACCGUUG | 1112 |
| 165 | AACGGUUCCCUUGAUUUCU | 1113 | AGAAAUCAAGGGAACCGUU | 1114 |
| 166 | ACGGUUCCCUUGAUUUCUU | 1115 | AAGAAAUCAAGGGAACCGU | 1116 |
| 167 | GUACAUUGACCAGACCAUG | 1117 | CAUGGUCUGGUCAAUGUAC | 1118 |
| 168 | ACCUGUACCACCUCCUGUG | 1119 | CACAGGAGGUGGUACAGGU | 1120 |
| 169 | CCUGUACCACCUCCUGUGU | 1121 | ACACAGGAGGUGGUACAGG | 1122 |
| 170 | GUACCACCUCCUGUGUCAU | 1123 | AUGACACAGGAGGUGGUAC | 1124 |
| 171 | GCACAGGCAUCAAGUUCUA | 1125 | UAGAACUUGAUGCCUGUGC | 1126 |
| 172 | ACAGGCAUCAAGUUCUACU | 1127 | AGUAGAACUUGAUGCCUGU | 1128 |
| 173 | CAGGCAUCAAGUUCUACUC | 1129 | GAGUAGAACUUGAUGCCUG | 1130 |
| 174 | AGGCAUCAAGUUCUACUCC | 1131 | GGAGUAGAACUUGAUGCCU | 1132 |
| 175 | GGCAUCAAGUUCUACUCCA | 1133 | UGGAGUAGAACUUGAUGCC | 1134 |
| 176 | GCAUCAAGUUCUACUCCAU | 1135 | AUGGAGUAGAACUUGAUGC | 1136 |
| 177 | CAUCAAGUUCUACUCCAUU | 1137 | AAUGGAGUAGAACUUGAUG | 1138 |
| 178 | AUCAAGUUCUACUCCAUUC | 1139 | GAAUGGAGUAGAACUUGAU | 1140 |
| 179 | UCAAGUUCUACUCCAUUCA | 1141 | UGAAUGGAGUAGAACUUGA | 1142 |
| 180 | CAAGUUCUACUCCAUUCAG | 1143 | CUGAAUGGAGUAGAACUUG | 1144 |
| 181 | AAGUUCUACUCCAUUCAGC | 1145 | GCUGAAUGGAGUAGAACUU | 1146 |
| 182 | AGUUCUACUCCAUUCAGCA | 1147 | UGCUGAAUGGAGUAGAACU | 1148 |
| 183 | GUUCUACUCCAUUCAGCAG | 1149 | CUGCUGAAUGGAGUAGAAC | 1150 |
| 184 | GUGUCAUCUCAGACAACCU | 1151 | AGGUUGUCUGAGAUGACAC | 1152 |
| 185 | CAUCUCAGACAACCUGCUG | 1153 | CAGCAGGUUGUCUGAGAUG | 1154 |
| 186 | UCAGACAACCUGCUGGUGA | 1155 | UCACCAGCAGGUUGUCUGA | 1156 |
| 187 | CGGGGACCUGUUACAGACA | 1157 | UGUCUGUAACAGGUCCCCG | 1158 |
| 188 | GACAACGCUGCCAUUGUCU | 1159 | AGACAAUGGCAGCGUUGUC | 1160 |
| 189 | GCUGCCUCCUGACUGUAAU | 1161 | AUUACAGUCAGGAGGCAGC | 1162 |
| 190 | CUGCCUCCUGACUGUAAUA | 1163 | UAUUACAGUCAGGAGGCAG | 1164 |
| 191 | UAAUAUUAAACUUUUUUAA | 1165 | UUAAAAAAGUUUAAUAUUA | 1166 |
| 192 | AAUAUUAAACUUUUUUAAA | 1167 | UUUAAAAAAGUUUAAUAUU | 1168 |

SEQUENCE LISTING (1169 sequences)

SEQ ID NO: 1 - DNA, 4254 bp, Homo sapiens
  source 1..4254: mol_type = genomic DNA
gggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccatatcatcatctgtcaggcactttgggagcta

SEQ ID NO: 2 - protein, 1279 aa, Homo sapiens
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTLQTSATLKDLLFGVPGKYSGVSLYTRKRMVSYTITLVFQHYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHVCVWDAQTGDCLTRIPRPGRQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKPITALKAAAGRLVTGSQDHTLRVFRLEDSCCLFTLQGHSGAITTVYIDQTMVLASGGQDGAICLWDVLTGSRVSHVFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 3 - DNA, 4226 bp, Mus musculus
  source 1..4226: mol_type = genomic DNA
gttgagaggtgaaggggcggggagctgcgcgggcgccgggcggccgggagggagagggcgggctccaaacaccggaccgcgggccaggagcgcgcaggccgttctccgccgctcggtcgccgccgcccgggagctgcctcgctgccacaggtgcctgcagatgatgtctgctgtaagtgatatccagcatcttccgggctgatccatggtcactttccgggatggcaacaaggtgacttagccgaggatgaccctgactgaaaggcttcgtgagaagatatctcaggccttctacaaccatgggctgctctgcgcatcctatccaattcccatcatcctcttcacaggactctgcatcttagcctgctgctacccgctgctgaagctccccttgcctggaacgggacctgtggaattctccacgcctgtgaagggttactcgcccccgcctgcggactctgaccacaaacaaggagagcccagcgagcagccagagtggtatgtgggtgcccccgtggcgtacatccaacagatatttgtgaagtcatcggtgtctccctggcacagaaatcttctggcagtcgatgtgttccggtcacctctgtcccgagcattccaactggtggaagagatccggaaccatgtgctgagagacagctcagggaccaagagcctggaggaggtttgcctgcaggtgacagacctgctgccaggcctcaggaaactccggagcctacttcccgaacatggctgcctgctgctgtcccctgggaacttctggcagaatgattgggagagattccatgccgaccctgacatcattgggaccatccatcaacatgagcccaaaactctacagacatcagccacactcaaagacttgctgtttggtgttcctgggaagtacagtggggtgagcctctacacaaggaaaaggatggtctcctacaccatcaccctggtcttccagcgctaccatgccaagtttctgagcagcctacgtgcccggctcatgctgctgcaccccagccccaactgcagcctccgagcagagaacctggtccacgtccacttcaaagaggagattggcattgctgagctcatcccgctcgtgaccacctacatcatcctgtttgcctacatctacttctccacacgcaagatcgacatggtcaagtccaagtggggcctcgccctggcagccgtggtcacagtacttagctcactgctcatgtctgtggggctctgcaccctcttcggcctgacgcccacactcaatggcggtgagatcttcccatacctggtggtcgttattgggctagagaacgtgttggtgctcaccaagtcagtggtatcaactccagtggacctcgaggtgaagcttcggattgcacaaggcttgagtagtgagagctggtccatcatgaagaacgcggcgaccgagctgggcatcatcctcattggctacttcaccctcgtgcctgctatccaggagttctgcctctttgctgttgtgggcctggtgtctgacttcttcctccagatgctgttcttcaccactgtcctgtcgatcgacattcgccggatggagctagcagacctaaacaagcggctgccccctgaatcctgcctgccctcagccaagcccgtggggaggccagcacgatatgagagacagcaggctgtacggccatccacgccacacaccatcacattgcaaccatcttccttccgaaacctgcggcttcccaaaaggctgcgtgtcatctacttcctggcccgcactcgcctggcccagcgcctcatcatggctggtaccgttgtctggattggcatcctggtatacaccgacccggcagggctgcgcacctaccttgctgcccaggtgacagagcagagcccactgggtgagggttccctgggccccatgcctgtgcctagcggagtgctgcctgccagccacccggaccctgcattctccatcttcccacctgatgctcctaaactgccagagaaccagaccttgccaggtgagctgcctgagcatgctggtccagcagagggtgtccatgacagccgagccccagaggtaacttgggggcctgaggatgaggagctgtggaggaaattgtccttccgccactggcccacactcttcaactactacaacatcacactggccaaaaggtacatcagcctgctgcctgtcatccctgtcacactacacctgaatccacgggaggctctggaggggcgacaccctcaggatggtcgcagtgcctgggccccacaagagcctttgcccgctggcctctgggagtccggacctaagggaccaggtggaacacagacccatggcgacattaccttgtacaaggtggccgcgcttggcctagcagcgggcatcgtcctggtgctgctgctgctctgcctctaccgggtgctctgcccgcgtaattatgggcagccgggtggtggccccggcaggcggaggcgcggggagctgccctgcgatgactacggctacgcaccgcccgagacggagatagtgccgctggtgctgcgaggtcacctcatggacatcgagtgtctggctagcgatgggatgctactagtgagctgctgcctggcaggccaagtctgcgtgtgggacgctcagacaggggactgcctcacacggatcccacgcccagggccacgccgggatagctgcggaggtggagcttttgagactcaggagaactgggaaaggctgtcagatggaggcaaggctagcccggaagaacctggagacagccctccgctgcgacgacgcccccgagggcctccaccgccttccctctttggggaccagcccgacctcacctgcttaatcgacaccaacttctcggtgcagctgcccccagagcccactcagcccgagcctcggcaccgggtgggctgtggccgctctagagactcgggttatgacttcagccgcctggtgcagcgtgtgtaccaggaggaaggcctggctgctatgcgcatgccggccctgcgcccaccctcccctggacctcccttgccccaggcctctcaagaagaggggactgcacctgagaagggctcccctcccctggcctggacccccagcacagccggttccatctggagcttagagctgcaaggcaatctcatcgtggttgggcggagcagcggccggctggaggtgtgggacgccattgagggggtgctctgctgcagcaatgaggagatctcctcaggcatcacagcccttgtcttcttggacaggaggattgtagctgctcggcttaatggttcccttgatttcttttctttggagacccacacttccctcagccccctgcagttcagagggaccccagggcgaggcagttctccttcctcatctgtgtacagcagcagcaacacagtgacctgtcatcggacccacacagtgccctgtgcacaccagaagcccatcacagccctgagagctgctgccgggcgcctagtgacagggagccaagaccatactctaagagtcttccgactggatgactcgtgttgcctctttaccctgaagggccactcaggggcaatcacagctgtgtacattgatcagaccatggtactggccagtggaggacaagatggagccatctgcctgtgggatgtactaacaggcagccgggtcagccaaacatttgctcaccgtggagatgttacctccctcacctgtaccgcttcctgtgtcattagtagtggcctggatgacttcatcagtatctgggaccgcagcacaggcatcaagctgtactccattcagcaggacctgggctgtggtgcaagcttgggtgtcatctcagataaccttctggtgaccggcggccagggctgtgtctccttttgggacctaaactatggggacctgttacagacagtctacttgggcaagaacagtgaagcccagcctgcccggcagattttggtgttggacaatgctgccattgtctgcaactttggcagtgagctcagcctagtgtatgtgccctctgtgctggagaaactggactgaaggcaggtcaagtacgctattccctttcccccatcccaaggtggggcacaggggatagcaactctttggacctagactagaggcaatagctgactctgaactgttgtctcctgactgtaataataaacttttttaaaaaaccacattt

SEQ ID NO: 4 - protein, 1276 aa, Mus musculus
MTLTERLREKISQAFYNHGLLCASYPIPIILFTGLCILACCYPLLKLPLPGTGPVEFSTPVKGYSPPPADSDHKQGEPSEQPEWYVGAPVAYIQQIFVKSSVSPWHRNLLAVDVFRSPLSRAFQLVEEIRNHVLRDSSGTKSLEEVCLQVTDLLPGLRKLRSLLPEHGCLLLSPGNFWQNDWERFHADPDIIGTIHQHEPKTLQTSATLKDLLFGVPGKYSGVSLYTRKRMVSYTITLVFQRYHAKFLSSLRARLMLLHPSPNCSLRAENLVHVHFKEEIGIAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNAATELGIILIGYFTLVPAIQEFCLFAVVGLVSDFFLQMLFFTTVLSIDIRRMELADLNKRLPPESCLPSAKPVGRPARYERQQAVRPSTPHTITLQPSSFRNLRLPKRLRVIYFLARTRLAQRLIMAGTVVWIGILVYTDPAGLRTYLAAQVTEQSPLGEGSLGPMPVPSGVLPASHPDPAFSIFPPDAPKLPENQTLPGELPEHAGPAEGVHDSRAPEVTWGPEDEELWRKLSFRHWPTLFNYYNITLAKRYISLLPVIPVTLHLNPREALEGRHPQDGRSAWAPQEPLPAGLWESGPKGPGGTQTHGDITLYKVAALGLAAGIVLVLLLLCLYRVLCPRNYGQPGGGPGRRRRGELPCDDYGYAPPETEIVPLVLRGHLMDIECLASDGMLLVSCCLAGQVCVWDAQTGDCLTRIPRPGPRRDSCGGGAFETQENWERLSDGGKASPEEPGDSPPLRRRPRGPPPPSLFGDQPDLTCLIDTNFSVQLPPEPTQPEPRHRVGCGRSRDSGYDFSRLVQRVYQEEGLAAMRMPALRPPSPGPPLPQASQEEGTAPEKGSPPLAWTPSTAGSIWSLELQGNLIVVGRSSGRLEVWDAIEGVLCCSNEEISSGITALVFLDRRIVAARLNGSLDFFSLETHTSLSPLQFRGTPGRGSSPSSSVYSSSNTVTCHRTHTVPCAHQKPITALRAAAGRLVTGSQDHTLRVFRLDDSCCLFTLKGHSGAITAVYIDQTMVLASGGQDGAICLWDVLTGSRVSQTFAHRGDVTSLTCTASCVISSGLDDFISIWDRSTGIKLYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 5 - DNA, 4281 bp, Rattus norvegicus
  source 1..4281: mol_type = genomic DNA
gaaggggcggggagctgcgcgggcgccgggcggccgggagggagagggcgggctcgaaacaccggatcgcgggccaggagcgcgcaggccgctctccgccgctccgtcgccgccgcccgggagctgcctcgccgccacaggcacctctcccgtggttggaggaaacgaggcattctagaaggggatagcaggtacctgcagatgatgtgcattgtcattggtatccagcatcttccaggctgatccatggtcactttccgggatggcaacaaggtgacttagctgaggatgaccctgactgaaaggcttcgtgagaagatatctcaggcgttctacaaccatgggctgctctgcgcatcctaccccattcccatcatcctcttcacaggactctgcatcctagcctgctgctacccgctgctgaagcttcccttgcctggaacgggacccgtggaattctccacgcctgtgaagggttactcgcccccgcctgcggactctgaccacaaacaaggagagcccagtgagcagccagagtggtatgtgggtgcccccgtggcatacatccagcagatattcgtgaagtcatcagtgtctccctggcacagaaaccttctggcagtagatgtgttccggtcacctctgtcccgagcattccaactggtggaagagatccggaaccatgtgctgagagacagctcagggaccaagagcctggaggaagtttgcctgcaggtgacagacctgctgccaggcctcaggaaactccggagcctacttcccgaacatggctgcctgctgctgtcacctgggaacttctggcagaatgactgggaaagattccatgctgaccctgacatcattggaaccatccatcagcatgagcctaaaaccctacagacatcagccacactcaaagacttgctgttcggtgttcctgggaagtacagtggggtcagcctctacacgaggaagaggatggtctcatacaccatcaccctggtcttccagcgctaccatgccaagtttctgagcagcctccgtgcccggctcatgcttctgcaccccagccccaactgcagcctccgagcagagaacctggtgcatgtgcacttcaaagaggagattggcattgccgagctcatccccctcgtgaccacctacatcatcctgtttgcctacatctacttctccacacgcaagatcgacatggtcaagtccaagtggggcctcgccctggcagccgtggtcacagtgcttagctcgctgctcatgtctgtggggctctgcactctcttcggcctgacgcccacactcaatggcggcgagattttcccatatctggtggtggttattgggctagagaatgtgttggtgctcaccaagtcagtggtatcaactccagtggaccttgaggtgaagcttcgaattgcacaaggcttaagcagtgagagctggtccatcatgaagaacgtagcaactgaactgggcatcatcctcattggctacttcacccttgtgcctgccatccaagagttctgcctctttgctgtggtgggcctggtgtctgacttcttcctccagatgctgttcttcaccaccgtgctgtccatcgacattcgccggatggagctagcagacctgaacaagcggctgccccctgagtcctgcctgccctcagccaagcctgtggggaggccagcccgatatgagagacagctagctgtacggccgtccacaccacacaccatcacattgcaaccatcttccttccgaaacctgcggcttcccaaaaggctgcgtgtcatctacttcctggcccgcactcgcctggcacagcgcctcatcatggctggtacagttgtctggattggcatcctggtatatacagacccggcagggctgcgcacctacctcgctgcccaggtgacagaacagagcccactgggtgagggttccctggggcccatgcctgtgcctagtggagtgctgcctgccagccacccggaccctgccttctccatcttcccacctgatgctcctaaactgccagagaaccagacgttgccaggtgagctgcctgagcatgccgttccagcagagggcgtccaggacagccgagccccagaggtgacttgggggcccgaggatgaggagctgtggaggaaattgtccttccgccactggcccacactcttcaactactataatatcacactggccaaaaggtacatcagcctgctgcctgtcatccctgtcacactacacctgaatccacgggaggctctggaggggcgacaccctcaggatggccgcactgcctgggccccaccagagcctttgcctgctggcctgtgggagaccggacctaaggggccaggtggaacacagacccatggcgacattaccttgtacaaggtggctgcacttggcctggcagcgggcattgtcctagtgctgctgctgctctgcctctaccgggtgctctgcccgcgaaactacgggcagccgggtggtggtgcgggcaggcggaggcgcggagagctgccttgcgatgactatggctacgcaccgcctgagacggagatagtgccgctggtgctgcgagggcacctcatggacatcgagtgtctggctagcgatgggatgctcctggtgagctgctgcctggctggccaagtctgcgtgtgggatgcacagaccggggactgcctcactcgcatcccgcgccctgggccacgccgggacagctgcggaggcggagcttttgaagctcaggagaactgggaaagactgtctgatgggggcaaagctagcccggaagagcctggcgacagccctccgctgcgacgccgccctcgagggcctccaccgccttccctctttggggaccagccagacctcacctgcttaatcgacaccaacttctcagtgcagctgcccccagagcccactcagcccgagcctcggcaccgggcgggctgtggccgctctagagactctggttacgacttcagccgtctggtgcagcgtgtgtaccaagaggaaggcctggctgctgtgcacatgtcggccctgcgcccaccctccccgggacctcccctgccccaggcctctcaagaagaggggactgctcccgagaagggctccccccctctggcctgggcccccagcacagccggttccatctggagcttagagttgcaaggcagtctcatcgtggttgggcgaagcagcggccggctggaggtgtgggatgccattgagggcgtgctctgctgcagcaatgaggagatctcctcaggcatcacagcccttgtcttcttagacaggaggattgtagctgctcggctcaacggttccctcgatttcttttccttggagacccacacttccctcagccccctgcagttcagagggaccccagggagaggcagttctccttcctcgcctgtgtacagcagcagcaacactgtggcctgtcacctgacccacacagtcccctgtgcacaccagaaacccatcacagccctgagagcagcagcggggcgcctggtgacagggagccaagaccatactctgagagtcttccgactggaggattcgtgttgcctctttaccctgcagggccactcgggggcaatcacaactgtgtacattgatcagaccatggtattggccagtggaggacaagatggagccatctgcctgtgggatgtactaacaggcagccgggtcagccatacatttgctcaccgtggagatgtcacctccctcacctgtaccacttcctgtgttatcagtagtggcctggatgacttcatcaacatctgggaccgaagcacaggcatcaagctgtactccattcagcaggacctgggctgtggtgcaagcttgggtgtcatctctgataaccttctggtgaccggcggccagggatgtgtctccttttgggacctaaactatggggacctgttacagacagtctacttgggaaagaacagtgaagcccagcctgcccggcagattttggtgctggacaatgctgccattgtctgcaactttggcagtgagctcagcctagtgtatgtgccctctgtgctggagaaactggactgaaggcaggtcaactgcactatgcctttcccccatcccaaggtggggcactggggattgcaactctttggacctagactggaggcaataggtaggcatctttgcagctgactcagaactgttgtctcctgactgtaataataaacttttttttaaaaaaccaca

SEQ ID NO: 6 - protein, 1276 aa, Rattus norvegicus
MTLTERLREKISQAFYNHGLLCASYPIPIILFTGLCILACCYPLLKLPLPGTGPVEFSTPVKGYSPPPADSDHKQGEPSEQPEWYVGAPVAYIQQIFVKSSVSPWHRNLLAVDVFRSPLSRAFQLVEEIRNHVLRDSSGTKSLEEVCLQVTDLLPGLRKLRSLLPEHGCLLLSPGNFWQNDWERFHADPDIIGTIHQHEPKTLQTSATLKDLLFGVPGKYSGVSLYTRKRMVSYTITLVFQRYHAKFLSSLRARLMLLHPSPNCSLRAENLVHVHFKEEIGIAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNVATELGIILIGYFTLVPAIQEFCLFAVVGLVSDFFLQMLFFTTVLSIDIRRMELADLNKRLPPESCLPSAKPVGRPARYERQLAVRPSTPHTITLQPSSFRNLRLPKRLRVIYFLARTRLAQRLIMAGTVVWIGILVYTDPAGLRTYLAAQVTEQSPLGEGSLGPMPVPSGVLPASHPDPAFSIFPPDAPKLPENQTLPGELPEHAVPAEGVQDSRAPEVTWGPEDEELWRKLSFRHWPTLFNYYNITLAKRYISLLPVIPVTLHLNPREALEGRHPQDGRTAWAPPEPLPAGLWETGPKGPGGTQTHGDITLYKVAALGLAAGIVLVLLLLCLYRVLCPRNYGQPGGGAGRRRRGELPCDDYGYAPPETEIVPLVLRGHLMDIECLASDGMLLVSCCLAGQVCVWDAQTGDCLTRIPRPGPRRDSCGGGAFEAQENWERLSDGGKASPEEPGDSPPLRRRPRGPPPPSLFGDQPDLTCLIDTNFSVQLPPEPTQPEPRHRAGCGRSRDSGYDFSRLVQRVYQEEGLAAVHMSALRPPSPGPPLPQASQEEGTAPEKGSPPLAWAPSTAGSIWSLELQGSLIVVGRSSGRLEVWDAIEGVLCCSNEEISSGITALVFLDRRIVAARLNGSLDFFSLETHTSLSPLQFRGTPGRGSSPSSPVYSSSNTVACHLTHTVPCAHQKPITALRAAAGRLVTGSQDHTLRVFRLEDSCCLFTLQGHSGAITTVYIDQTMVLASGGQDGAICLWDVLTGSRVSHTFAHRGDVTSLTCTTSCVISSGLDDFINIWDRSTGIKLYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 7 - DNA, 4135 bp, Macaca mulatta
  source 1..4135: mol_type = genomic DNA
  misc_difference 2422: note = a, c, u, g, unknown or other
  misc_difference 2423: note = a, c, u, g, unknown or other
  misc_difference 2424: note = a, c, u, g, unknown or other
  misc_difference 2425: note = a, c, u, g, unknown or other
  misc_difference 2426: note = a, c, u, g, unknown or other
  misc_difference 2427: note = a, c, u, g, unknown or other
  misc_difference 2428: note = a, c, u, g, unknown or other
  misc_difference 2429: note = a, c, u, g, unknown or other
  misc_difference 2430: note = a, c, u, g, unknown or other
  misc_difference 2431: note = a, c, u, g, unknown or other
  misc_difference 2432: note = a, c, u, g, unknown or other
  misc_difference 2433: note = a, c, u, g, unknown or other
  misc_difference 2434: note = a, c, u, g, unknown or other
  misc_difference 2435: note = a, c, u, g, unknown or other
  misc_difference 2436: note = a, c, u, g, unknown or other
  misc_difference 2437: note = a, c, u, g, unknown or other
agggagagagagagagagtgtgtgtgtgtgtgagtgtgtgtgtgtattttggaattgatgtcactagaacttacatacaggcattctgaaaccattccccagccacataactatcgcctccctccagcagccctagtgtgcagagccaagtactctttgttaactggcttttctcccttctgaccaggtacctgcacatgttgttctttgtcagtgccgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcgtatcccatccccatcatcctcttcacggggttctgcatcttagcctgctgctacccactgctgaaactccccttgccaggaacaggacctgtggaattcaccacccctgtaaaggattactcgcccccgcctgtggactctgaccgcaaacaaggagagcctacggagcagcctgagtggtatgtgggtgccccggtggcttacgtccagcagatatttgtgaaatcctcagtgtttccctggcacaagaacctcctggcagtagatgtatttcgttcacctttgtcccgggcattccaactggtggaggagatccggaaccacgtgctgagagacagctctgggaccaggagcttggaggagttgtgtctgcaagtgaccgacctgctgccaggcctcaggaagctcagggacctactccctgagcatggatgcctgctgctgtcccctgggaatttctggcagaatgaccgggaacgcttccatgctgatcctgacatcattgggaccatccaccagcacgagcctaaaaccctgcagacttcagccacactcaaagacttgttgtttggtgttcccgggaagtacagcggggtgagcctctacaccaggaagaggatggtctcctacaccatcaccctggtcttccagcgctaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggccgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtccgtggtctcaaccccggtagacctggaggtgaagctgcggatcgcccaaggcctaagcagcgagagctggtccatcatgaagaacatggccacggagctgggcatcatcctcattggctacttcaccctagtgcctgccatccaggagttctgtctctttgctgtcgtggggctggtgtctgacttcttccttcagatgctgtttttcaccactgtcctgtccattgacattcgccggatggagctagcggacctgaacaagcggctgccccctgaggcctgcctaccctcagccaagccagtggggcagccaacgcgctacgagcggcagctggctgtgcggccgtccacaccccacaccatcacgttgcagccgtcttccttccgaaacctgcggctccccaagaggctgcgtgttgtctacttcctggcccgcacccgcctggcacagcgtctcatcatggctggcaccgttgtctggattggcatcctggtatacacagacccagcagggctgcgcacctacctcgctgcccaggtgacggaacagagcccgctgggtgagggagccctggctcccatgcccgtgcctagtggcatgctgcccgccagccacccggaccctgccttctccatcttcccacctgatgcccctaagctacctgagaaccagacatcgccaggcgagccacctgagcatggaggtccagcagaggttgtccatgacagcccagtcccagaggtaacctgggggcctgaggatgaggaactttggaggaaattgtccttccgccactggccgacgctcttcagctattacaacatcacgctggccaagaggtacatcagcctgctgcctgtcatcccagtcacactccgcctgaacccgagggaggccctggagggccggcaccctcaggatggccgcagtgcctggcccccaccggggcccatacctgctgggcactgggaagcgggacccaagggcccaggtggggtgcaggcccatggagacgtcacactgtacaaggtggcgnnnnnnnnnnnnnnnnttgtgccgctggtcctgcgcggccacctcatggatatcgagtgcctggccagcgacggcatgctgctggtgagctgttgcctggcaggccacgtctgtgtgtgggacgcacagaccggggattgcctcacgcgtatcccgcgcccagggcagcgccgggacagtggcgtgggcagcgggcttgaggctcaggagagctgggaacgactttcagatggtgggaaggctggcccagaggagcctggggacagccctcccctgagacaccgcccccgggaccctccaccgccttccctcttcggggaccagcctgacctcacctgcttaattgacaccaacttttcggcgcagccacagccctcacagcccactcagcctgagccccggcaccgggcggtctgtggccgcgctcgggactccctaggctatgacttcagccgcctggtgcagcgcgtgtaccaggaggaggggctggcggccgtctgcacaccagccctgcgcccaccctcgcctgggccggtgctgccccaggcccctgaggacgagggtggctcccctgagaaaggctccccttcccttgcctgggcccccagtgcggagggttccatctggagcttggagctgcagggccacctcatcgtggtggggcggagcagcggccggctggaggtgtgggacgccattgaaggggtgctgtgctgcagcagcgaggaggtctcctcaggcattaccgctctggtcttcttggacaaaaggattgtggctgcgcggctcaacggttcccttgatttcttctccttggagacccacactgccctcagccccctgcagtttagagggaccccggggcagggcagttcccctgcctctccagtgtacggcagcagtgacacagtggcctgtcgcctgacccacacagtgccctgtgcacaccaaaaacccatcacagccctgaaagccgctgccgggcgcttggtgactgggagtcaagaccacacgctgagagtattccgtctggaggactcgtgctgcctcttcacccttcagggccactcgggggccatcacgactgtgtacattgaccagaccatggtgctggccagtggaggacaagatggggccatctgcctgtgggatgtactgactggcagccgggtcagccacatgtttgctcaccgtggggatgtcacctccctcacctgtaccacctcctgtgtcatcagcagtggcctggatgacctcatcagcatctgggaccgcagcacaggcatcaagttctactccattcagcaggatctgggctgtggtgcaagcttgggtgtcatctcagacaacctgctggtgaccggcggccaaggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctccgtgctggagaagctggactgagcatggggcctccctgcccaggcaggggtctggggtgctgtgtgggggccaatgcactgaacctggacttgggggaaagagccgagtatcttccagccgctgcctcctgactgtaatattaaacttttttaaaaaaccacatctgtcaggcactttggga

SEQ ID NO: 8 - protein, 1229 aa, Macaca mulatta
  VARIANT 713: note = Any amino acid
  VARIANT 714: note = Any amino acid
  VARIANT 715: note = Any amino acid
  VARIANT 716: note = Any amino acid
  VARIANT 717: note = Any amino acid
  VARIANT 718: note = Any amino acid
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGTRSLEELCLQVTDLLPGLRKLRDLLPEHGCLLLSPGNFWQNDRERFHADPDIIGTIHQHEPKTLQTSATLKDLLFGVPGKYSGVSLYTRKRMVSYTITLVFQRYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRTYLAAQVTEQSPLGEGALAPMPVPSGMLPASHPDPAFSIFPPDAPKLPENQTSPGEPPEHGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAXXXXXXVPLVLRGHLMDIECLASDGMLLVSCCLAGHVCVWDAQTGDCLTRIPRPGQRRDSGVGSGLEAQESWERLSDGGKAGPEEPGDSPPLRHRPRDPPPPSLFGDQPDLTCLIDTNFSAQPQPSQPTQPEPRHRAVCGRARDSLGYDFSRLVQRVYQEEGLAAVCTPALRPPSPGPVLPQAPEDEGGSPEKGSPSLAWAPSAEGSIWSLELQGHLIVVGRSSGRLEVWDAIEGVLCCSSEEVSSGITALVFLDKRIVAARLNGSLDFFSLETHTALSPLQFRGTPGQGSSPASPVYGSSDTVACRLTHTVPCAHQKPITALKAAAGRLVTGSQDHTLRVFRLEDSCCLFTLQGHSGAITTVYIDQTMVLASGGQDGAICLWDVLTGSRVSHMFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 9 - RNA, 36 nt, synthetic construct
  source 1..36: mol_type = other RNA
tgtttgcctacatctacttagcagccgaaaggctgc

SEQ ID NO: 10 - RNA, 22 nt, synthetic construct
  source 1..22: mol_type = other RNA
taagtagatgtaggcaaacagg

SEQ ID NO: 11 - RNA, 36 nt, synthetic construct
  source 1..36: mol_type = other RNA
gtttgcctacatctacttcagcagccgaaaggctgc

SEQ ID NO: 12 - RNA, 22 nt, synthetic construct
  source 1..22: mol_type = other RNA
tgaagtagatgtaggcaaacgg

SEQ ID NO: 13 - RNA, 36 nt, synthetic construct
  source 1..36: mol_type = other RNA
tttgcctacatctacttctagcagccgaaaggctgc

SEQ ID NO: 14 - RNA, 22 nt, synthetic construct
  source 1..22: mol_type = other RNA
tagaagtagatgtaggcaaagg

SEQ ID NO: 15 - RNA, 36 nt, synthetic construct
  source 1..36: mol_type = other RNA
gcctacatctacttctccaagcagccgaaaggctgc

SEQ ID NO: 16 - RNA, 22 nt, synthetic construct
  source 1..22: mol_type = other RNA
ttggagaagtagatgtaggcgg

SEQ ID NO: 17 - RNA, 36 nt, synthetic construct
  source 1..36: mol_type = other RNA
aagatcgacatggtcaagtagcagccgaaaggctgc

SEQ ID NO: 18 - RNA, 22 nt, synthetic construct
  source 1..22: mol_type = other RNA
tacttgaccatgtcgatcttgg

SEQ ID NO: 19 - RNA, 36 nt, synthetic construct
  source 1..36: mol_type = other RNA
agatcgacatggtcaagtcagcagccgaaaggctgc

SEQ ID NO: 20 - RNA, 22 nt, synthetic construct
  source 1..22: mol_type = other RNA
tgacttgaccatgtcgatctgg

SEQ ID NO: 21 - RNA, 36 nt, synthetic construct
  source 1..36: mol_type = other RNA
atcgacatggtcaagtccaagcagccgaaaggctgc

SEQ ID NO: 22 - RNA, 22 nt, synthetic construct
  source 1..22: mol_type = other RNA
ttggacttgaccatgtcgatgg

SEQ ID NO: 23 - RNA, 36 nt, synthetic construct
  source 1..36: mol_type = other RNA
gtgttggtgctcaccaagtagcagccgaaaggctgc

SEQ ID NO: 24 - RNA, 22 nt, synthetic construct
  source 1..22: mol_type = other RNA
tacttggtgagcaccaacacgg

SEQ ID NO: 25 - RNA, 36 nt, synthetic construct
  source 1..36: mol_type = other RNA
tgttggtgctcaccaagtcagcagccgaaaggctgc

SEQ ID NO: 26 - RNA, 22 nt, synthetic construct
  source 1..22: mol_type = other RNA
tgacttggtgagcaccaacagg

SEQ ID NO: 27 - RNA, 36 nt, synthetic construct
  source 1..36: mol_type = other RNA
gagagctggtccatcatgaagcagccgaaaggctgc

SEQ ID NO: 28 - RNA, 22 nt, synthetic construct
  source 1..22: mol_type = other RNA
ttcatgatggaccagctctcgg

SEQ ID NO: 29 - RNA, 36 nt, synthetic construct
  source 1..36: mol_type = other RNA
agagctggtccatcatgaaagcagccgaaaggctgc

SEQ ID NO: 30 - RNA, 22 nt, synthetic construct
  source 1..22: mol_type = other RNA
tttcatgatggaccagctctgg

SEQ ID NO: 31 - RNA, 36 nt, synthetic construct
  source 1..36: mol_type = other RNA
gagctggtccatcatgaagagcagccgaaaggctgc

SEQ ID NO: 32 - RNA, 22 nt, synthetic construct
  source 1..22: mol_type = other RNA
tcttcatgatggaccagctcgg

SEQ ID NO: 33 - RNA, 36 nt, synthetic construct
  source 1..36: mol_type = other RNA
agctggtccatcatgaagaagcagccgaaaggctgc

SEQ ID NO: 34 - RNA, 22 nt, synthetic construct
  source 1..22: mol_type = other RNA
ttcttcatgatggaccagctgg

SEQ ID NO: 35 - RNA, 36 nt, synthetic construct
  source 1..36: mol_type = other RNA
gctggtccatcatgaagaaagcagccgaaaggctgc

SEQ ID NO: 36 - RNA, 22 nt, synthetic construct
  source 1..22: mol_type = other RNA
tttcttcatgatggaccagcgg

SEQ ID NO: 37 - RNA, 36 nt, synthetic construct
  source 1..36: mol_type = other RNA
ctggtccatcatgaagaacagcagccgaaaggctgc

SEQ ID NO: 38 - RNA, 22 nt, synthetic construct
  source 1..22: mol_type = other RNA
tgttcttcatgatggaccaggg

SEQ ID NO: 39 - RNA, 36 nt, synthetic construct
  source 1..36: mol_type = other RNA
ccgttgtctggattggcatagcagccgaaaggctgc

SEQ ID NO: 40 - RNA, 22 nt, synthetic construct
  source 1..22: mol_type = other RNA
tatgccaatccagacaacgggg

SEQ ID NO: 41 - RNA, 36 nt, synthetic construct
  source 1..36: mol_type = other RNA
ttgtctggattggcatcctagcagccgaaaggctgc

SEQ ID NO: 42 - RNA, 22 nt, synthetic construct
  source 1..22: mol_type = other RNA
taggatgccaatccagacaagg

SEQ ID NO: 43 - RNA, 36 nt, synthetic construct
  source 1..36: mol_type = other RNA
tgtctggattggcatcctgagcagccgaaaggctgc

SEQ ID NO: 44 - RNA, 22 nt, synthetic construct
  source 1..22: mol_type = other RNA
tcaggatgccaatccagacagg

SEQ ID NO: 45 - RNA, 36 nt, synthetic construct
  source 1..36: mol_type = other RNA
gtctggattggcatcctggagcagccgaaaggctgc

SEQ ID NO: 46 - RNA, 22 nt, synthetic construct
  source 1..22: mol_type = other RNA
tccaggatgccaatccagacgg

SEQ ID NO: 47 - RNA, 36 nt, synthetic construct
  source 1..36: mol_type = other RNA
ctggattggcatcctggtaagcagccgaaaggctgc

SEQ ID NO: 48 - RNA, 22 nt, synthetic construct
  source 1..22: mol_type = other RNA
ttaccaggatgccaatccaggg

SEQ ID NO: 49 - RNA, 36 nt, synthetic construct
  source 1..36: mol_type = other RNA
tggattggcatcctggtatagcagccgaaaggctgc

SEQ ID NO: 50 - RNA, 22 nt, synthetic construct
  source 1..22: mol_type = other RNA
tataccaggatgccaatccagg

SEQ ID NO: 51 - RNA, 36 nt, synthetic construct
  source 1..36: mol_type = other RNA
ggattggcatcctggtataagcagccgaaaggctgc

SEQ ID NO: 52 - RNA, 22 nt, synthetic construct
  source 1..22: mol_type = other RNA
ttataccaggatgccaatccgg

SEQ ID NO: 53 - RNA, 36 nt, synthetic construct
  source 1..36: mol_type = other RNA
gattggcatcctggtatacagcagccgaaaggctgc

SEQ ID NO: 54 - RNA, 22 nt, synthetic construct
  source 1..22: mol_type = other RNA
tgtataccaggatgccaatcgg

SEQ ID NO: 55 - RNA, 36 nt, synthetic construct
  source 1..36: mol_type = other RNA
attggcatcctggtatacaagcagccgaaaggctgc

SEQ ID NO: 56 - RNA, 22 nt, synthetic construct
  source 1..22: mol_type = other RNA
ttgtataccaggatgccaatgg

SEQ ID NO: 57 - RNA, 36 nt, synthetic construct
  source 1..36: mol_type = other RNA
ctccatcttcccacctgatagcagccgaaaggctgc

SEQ ID NO: 58 - RNA, 22 nt, synthetic construct
  source 1..22: mol_type = other RNA
tatcaggtgggaagatggaggg

SEQ ID NO: 59 - RNA, 36 nt, synthetic construct
  source 1..36: mol_type = other RNA
catctgcctgtgggatgtaagcagccgaaaggctgc

SEQ ID NO: 60 - RNA, 22 nt, synthetic construct
  source 1..22: mol_type = other RNA
ttacatcccacaggcagatggg

SEQ ID NO: 61 - RNA, 36 nt, synthetic construct
  source 1..36: mol_type = other RNA
tctgcctgtgggatgtactagcagccgaaaggctgc

SEQ ID NO: 62 - RNA, 22 nt, synthetic construct
  source 1..22: mol_type = other RNA
tagtacatcccacaggcagagg

SEQ ID NO: 63 - RNA, 36 nt, synthetic construct
  source 1..36: mol_type = other RNA
gtggtgcaagcttgggtgtagcagccgaaaggctgc

SEQ ID NO: 64 - RNA, 22 nt, synthetic construct
  source 1..22: mol_type = other RNA
tacacccaagcttgcaccacgg

SEQ ID NO: 65 - RNA, 36 nt, synthetic construct
  source 1..36: mol_type = other RNA
tggtgcaagcttgggtgtcagcagccgaaaggctgc

SEQ ID NO: 66 - RNA, 22 nt, synthetic construct
  source 1..22: mol_type = other RNA
tgacacccaagcttgcaccagg

SEQ ID NO: 67 - RNA, 36 nt, synthetic construct
  source 1..36: mol_type = other RNA
ggtgcaagcttgggtgtcaagcagccgaaaggctgc

SEQ ID NO: 68 - RNA, 22 nt, synthetic construct
  source 1..22: mol_type = other RNA
ttgacacccaagcttgcaccgg

SEQ ID NO: 69 - RNA, 36 nt, synthetic construct
  source 1..36: mol_type = other RNA
gtgcaagcttgggtgtcatagcagccgaaaggctgc

SEQ ID NO: 70 - RNA, 22 nt, synthetic construct
  source 1..22: mol_type = other RNA
tatgacacccaagcttgcacgg

SEQ ID NO: 71 - RNA, 36 nt, synthetic construct
  source 1..36: mol_type = other RNA
gcaagcttgggtgtcatctagcagccgaaaggctgc

SEQ ID NO: 72 - RNA, 22 nt, synthetic construct
  source 1..22: mol_type = other RNA
tagatgacacccaagcttgcgg

SEQ ID NO: 73 - RNA, 36 nt, synthetic construct
  source 1..36: mol_type = other RNA
caagcttgggtgtcatctcagcagccgaaaggctgc

SEQ ID NO: 74 - RNA, 22 nt, synthetic construct
  source 1..22: mol_type = other RNA
tgagatgacacccaagcttggg

SEQ ID NO: 75 - RNA, 36 nt, synthetic construct
  source 1..36: mol_type = other RNA
aagcttgggtgtcatctcaagcagccgaaaggctgc

SEQ ID NO: 76 - RNA, 22 nt, synthetic construct
  source 1..22: mol_type = other RNA
ttgagatgacacccaagcttgg

SEQ ID NO: 77 - RNA, 36 nt, synthetic construct
  source 1..36: mol_type = other RNA
agcttgggtgtcatctcagagcagccgaaaggctgc

SEQ ID NO: 78 - RNA, 22 nt, synthetic construct
  source 1..22: mol_type = other RNA
tctgagatgacacccaagctgg

SEQ ID NO: 79 - RNA, 36 nt, synthetic construct
  source 1..36: mol_type = other RNA
gcttgggtgtcatctcagaagcagccgaaaggctgc

SEQ ID NO: 80 - RNA, 22 nt, synthetic construct
  source 1..22: mol_type = other RNA
ttctgagatgacacccaagcgg

SEQ ID NO: 81 - RNA, 36 nt, synthetic construct
  source 1..36: mol_type = other RNA
gtgtctccttttgggacctagcagccgaaaggctgc

SEQ ID NO: 82 - RNA, 22 nt, synthetic construct
  source 1..22: mol_type = other RNA
taggtcccaaaaggagacacgg

SEQ ID NO: 83 - RNA, 36 nt, synthetic construct
  source 1..36: mol_type = other RNA
tgtctccttttgggacctaagcagccgaaaggctgc

SEQ ID NO: 84 - RNA, 22 nt, synthetic construct
  source 1..22: mol_type = other RNA
ttaggtcccaaaaggagacagg

SEQ ID NO: 85 - RNA, 36 nt, synthetic construct
  source 1..36: mol_type = other RNA
ggggacctgttacagacagagcagccgaaaggctgc

SEQ ID NO: 86 - RNA, 22 nt, synthetic construct
  source 1..22: mol_type = other RNA
tctgtctgtaacaggtccccgg

SEQ ID NO: 87 - RNA, 36 nt, synthetic construct
  source 1..36: mol_type = other RNA
gggacctgttacagacagtagcagccgaaaggctgc

SEQ ID NO: 88 - RNA, 22 nt, synthetic construct
  source 1..22: mol_type = other RNA
tactgtctgtaacaggtcccgg

SEQ ID NO: 89 - RNA, 36 nt, synthetic construct
  source 1..36: mol_type = other RNA
ggacctgttacagacagtcagcagccgaaaggctgc

SEQ ID NO: 90 - RNA, 22 nt, synthetic construct
  source 1..22: mol_type = other RNA
tgactgtctgtaacaggtccgg

SEQ ID NO: 91 - RNA, 36 nt, synthetic construct
  source 1..36: mol_type = other RNA
gacctgttacagacagtctagcagccgaaaggctgc

SEQ ID NO: 92 - RNA, 22 nt, synthetic construct
  source 1..22: mol_type = other RNA
tagactgtctgtaacaggtcgg

SEQ ID NO: 93 - RNA, 36 nt, synthetic construct
  source 1..36: mol_type = other RNA
acctgttacagacagtctaagcagccgaaaggctgc

SEQ ID NO: 94 - RNA, 22 nt, synthetic construct
  source 1..22: mol_type = other RNA
ttagactgtctgtaacaggtgg

SEQ ID NO: 95 - RNA, 36 nt, synthetic construct
  source 1..36: mol_type = other RNA
tgccattgtctgcaactttagcagccgaaaggctgc

SEQ ID NO: 96 - RNA, 22 nt, synthetic construct
  source 1..22: mol_type = other RNA
taaagttgcagacaatggcagg

SEQ ID NO: 97 - RNA, 36 nt, synthetic construct
  source 1..36: mol_type = other RNA
gccattgtctgcaactttgagcagccgaaaggctgc

SEQ ID NO: 98 - RNA, 22 nt, synthetic construct
  source 1..22: mol_type = other RNA
tcaaagttgcagacaatggcgg

SEQ ID NO: 99 - RNA, 36 nt, synthetic construct
  source 1..36: mol_type = other RNA
ccattgtctgcaactttggagcagccgaaaggctgc

SEQ ID NO: 100 - RNA, 22 nt, synthetic construct
  source 1..22: mol_type = other RNA
tccaaagttgcagacaatgggg

SEQ ID NO: 101 - RNA, 36 nt, synthetic construct
  source 1..36: mol_type = other RNA
attgtctgcaactttggcaagcagccgaaaggctgc

SEQ ID NO: 102 - RNA, 22 nt, synthetic construct
  source 1..22: mol_type = other RNA
ttgccaaagttgcagacaatgg

SEQ ID NO: 103 - RNA, 36 nt, synthetic construct
  source 1..36: mol_type = other RNA
tctgcaactttggcagtgaagcagccgaaaggctgc

SEQ ID NO: 104 - RNA, 22 nt, synthetic construct
  source 1..22: mol_type = other RNA
ttcactgccaaagttgcagagg

SEQ ID NO: 105 - RNA, 36 nt, synthetic construct
  source 1..36: mol_type = other RNA
ctacccactgctgaaactcagcagccgaaaggctgc

SEQ ID NO: 106 - RNA, 22 nt, synthetic construct
  source 1..22: mol_type = other RNA
tgagtttcagcagtgggtaggg

SEQ ID NO: 107 - RNA, 36 nt, synthetic construct
  source 1..36: mol_type = other RNA
gccaggaacaggacctgtgagcagccgaaaggctgc

SEQ ID NO: 108 - RNA, 22 nt, synthetic construct
  source 1..22: mol_type = other RNA
tcacaggtcctgttcctggcgg

SEQ ID NO: 109 - RNA, 36 nt, synthetic construct
  source 1..36: mol_type = other RNA
gaacaggacctgtggaattagcagccgaaaggctgc

SEQ ID NO: 110 - RNA, 22 nt, synthetic construct
  source 1..22: mol_type = other RNA
taattccacaggtcctgttcgg

SEQ ID NO: 111 - RNA, 36 nt, synthetic construct
  source 1..36: mol_type = other RNA
acaggacctgtggaattcaagcagccgaaaggctgc

SEQ ID NO: 112 - RNA, 22 nt, synthetic construct
  source 1..22: mol_type = other RNA
ttgaattccacaggtcctgtgg

SEQ ID NO: 113 - RNA, 36 nt, synthetic construct
  source 1..36: mol_type = other RNA
tggaattcaccacccctgtagcagccgaaaggctgc

SEQ ID NO: 114 - RNA, 22 nt, synthetic construct
  source 1..22: mol_type = other RNA
tacaggggtggtgaattccagg

SEQ ID NO: 115 - RNA, 36 nt, synthetic construct
  source 1..36: mol_type = other RNA
cttgtgaccacctacatcaagcagccgaaaggctgc

SEQ ID NO: 116 - RNA, 22 nt, synthetic construct
  source 1..22: mol_type = other RNA
ttgatgtaggtggtcacaaggg

SEQ ID NO: 117 - RNA, 36 nt, synthetic construct
  source 1..36: mol_type = other RNA
ttgtgaccacctacatcatagcagccgaaaggctgc

SEQ ID NO: 118 - RNA, 22 nt, synthetic construct
  source 1..22: mol_type = other RNA
tatgatgtaggtggtcacaagg

SEQ ID NO: 119 - RNA, 36 nt, synthetic construct
  source 1..36: mol_type = other RNA
tgtgaccacctacatcatcagcagccgaaaggctgc

SEQ ID NO: 120 - RNA, 22 nt, synthetic construct
  source 1..22: mol_type = other RNA
tgatgatgtaggtggtcacagg

SEQ ID NO: 121 - RNA, 36 nt, synthetic construct
  source 1..36: mol_type = other RNA
gtgaccacctacatcatctagcagccgaaaggctgc

SEQ ID NO: 122 - RNA, 22 nt, synthetic construct
  source 1..22: mol_type = other RNA
tagatgatgtaggtggtcacgg

SEQ ID NO: 123 - RNA, 36 nt, synthetic construct
  source 1..36: mol_type = other RNA
tgaccacctacatcatcttagcagccgaaaggctgc

SEQ ID NO: 124 - RNA, 22 nt, synthetic construct
  source 1..22: mol_type = other RNA
taagatgatgtaggtggtcagg

SEQ ID NO: 125 - RNA, 36 nt, synthetic construct
  source 1..36: mol_type = other RNA
gaccacctacatcatcttgagcagccgaaaggctgc

SEQ ID NO: 126 - RNA, 22 nt, synthetic construct
  source 1..22: mol_type = other RNA
tcaagatgatgtaggtggtcgg

SEQ ID NO: 127 - RNA, 36 nt, synthetic construct
  source 1..36: mol_type = other RNA
accacctacatcatcttgtagcagccgaaaggctgc

SEQ ID NO: 128 - RNA, 22 nt, synthetic construct
  source 1..22: mol_type = other RNA
tacaagatgatgtaggtggtgg

SEQ ID NO: 129 - RNA, 36 nt, synthetic construct
  source 1..36: mol_type = other RNA
ccacctacatcatcttgttagcagccgaaaggctgc

SEQ ID NO: 130 - RNA, 22 nt, synthetic construct
  source 1..22: mol_type = other RNA
taacaagatgatgtaggtgggg

SEQ ID NO: 131 - RNA, 36 nt, synthetic construct
  source 1..36: mol_type = other RNA
cacctacatcatcttgtttagcagccgaaaggctgc

SEQ ID NO: 132 - RNA, 22 nt, synthetic construct
  source 1..22: mol_type = other RNA
taaacaagatgatgtaggtggg

SEQ ID NO: 133 - RNA, 36 nt, synthetic construct
  source 1..36: mol_type = other RNA
acctacatcatcttgtttgagcagccgaaaggctgc

SEQ ID NO: 134 - RNA, 22 nt, synthetic construct
  source 1..22: mol_type = other RNA
tcaaacaagatgatgtaggtgg

SEQ ID NO: 135 - RNA, 36 nt, synthetic construct
  source 1..36: mol_type = other RNA
cctacatcatcttgtttgcagcagccgaaaggctgc

SEQ ID NO: 136 - RNA, 22 nt, synthetic construct
  source 1..22: mol_type = other RNA
tgcaaacaagatgatgtagggg

SEQ ID NO: 137 - RNA, 36 nt, synthetic construct
  source 1..36: mol_type = other RNA
ctacatcatcttgtttgccagcagccgaaaggctgc

SEQ ID NO: 138 - RNA, 22 nt, synthetic construct
  source 1..22: mol_type = other RNA
tggcaaacaagatgatgtaggg

SEQ ID NO: 139 - RNA, 36 nt, synthetic construct
  source 1..36: mol_type = other RNA
acatcatcttgtttgcctaagcagccgaaaggctgc

SEQ ID NO: 140 - RNA, 22 nt, synthetic construct
  source 1..22: mol_type = other RNA
ttaggcaaacaagatgatgtgg

SEQ ID NO: 141 - RNA, 36 nt, synthetic construct
  source 1..36: mol_type = other RNA
atcatcttgtttgcctacaagcagccgaaaggctgc

SEQ ID NO: 142 - RNA, 22 nt, synthetic construct
  source 1..22: mol_type = other RNA
ttgtaggcaaacaagatgatgg

SEQ ID NO: 143 - RNA, 36 nt, synthetic construct
  source 1..36: mol_type = other RNA
tcatcttgtttgcctacatagcagccgaaaggctgc

SEQ ID NO: 144 - RNA, 22 nt, synthetic construct
  source 1..22: mol_type = other RNA
tatgtaggcaaacaagatgagg

SEQ ID NO: 145 - RNA, 36 nt, synthetic construct
  source 1..36: mol_type = other RNA
atcttgtttgcctacatctagcagccgaaaggctgc

SEQ ID NO: 146 - RNA, 22 nt, synthetic construct
  source 1..22: mol_type = other RNA
tagatgtaggcaaacaagatgg

SEQ ID NO: 147 - RNA, 36 nt, synthetic construct
  source 1..36: mol_type = other RNA
tcttgtttgcctacatctaagcagccgaaaggctgc

SEQ ID NO: 148 - RNA, 22 nt, synthetic construct
  source 1..22: mol_type = other RNA
ttagatgtaggcaaacaagagg

SEQ ID NO: 149 - RNA, 36 nt, synthetic construct
  source 1..36: mol_type = other RNA
tttcccctaccttgtggtgagcagccgaaaggctgc

SEQ ID NO: 150 - RNA, 22 nt, synthetic construct
  source 1..22: mol_type = other RNA
tcaccacaaggtaggggaaagg

SEQ ID NO: 151 - RNA, 36 nt, synthetic construct
  source 1..36: mol_type = other RNA
ttcccctaccttgtggtggagcagccgaaaggctgc

SEQ ID NO: 152 - RNA, 22 nt, synthetic construct
  source 1..22: mol_type = other RNA
tccaccacaaggtaggggaagg

SEQ ID NO: 153 - RNA, 36 nt, synthetic construct
  source 1..36: mol_type = other RNA
ccctaccttgtggtggttaagcagccgaaaggctgc

SEQ ID NO: 154 - RNA, 22 nt, synthetic construct
  source 1..22: mol_type = other RNA
ttaaccaccacaaggtaggggg

SEQ ID NO: 155 - RNA, 36 nt, synthetic construct
  source 1..36: mol_type = other RNA
ctaccttgtggtggttattagcagccgaaaggctgc

SEQ ID NO: 156 - RNA, 22 nt, synthetic construct
  source 1..22: mol_type = other RNA
taataaccaccacaaggtaggg

SEQ ID NO: 157 - RNA, 36 nt, synthetic construct
  source 1..36: mol_type = other RNA
taccttgtggtggttattgagcagccgaaaggctgc

SEQ ID NO: 158 - RNA, 22 nt, synthetic construct
  source 1..22: mol_type = other RNA
tcaataaccaccacaaggtagg

SEQ ID NO: 159 - RNA, 36 nt, synthetic construct
  source 1..36: mol_type = other RNA
accttgtggtggttattggagcagccgaaaggctgc

SEQ ID NO: 160 - RNA, 22 nt, synthetic construct
  source 1..22: mol_type = other RNA
tccaataaccaccacaaggtgg

SEQ ID NO: 161 - RNA, 36 nt, synthetic construct
  source 1..36: mol_type = other RNA
ccttgtggtggttattgggagcagccgaaaggctgc

SEQ ID NO: 162 - RNA, 22 nt, synthetic construct
  source 1..22: mol_type = other RNA
tcccaataaccaccacaagggg

SEQ ID NO: 163 - RNA, 36 nt, synthetic construct
  source 1..36: mol_type = other RNA
cttgtggtggttattgggtagcagccgaaaggctgc

SEQ ID NO: 164 - RNA, 22 nt, synthetic construct
  source 1..22: mol_type = other RNA
tacccaataaccaccacaaggg

SEQ ID NO: 165 - RNA, 36 nt, synthetic construct
  source 1..36: mol_type = other RNA
ttgtggtggttattgggttagcagccgaaaggctgc

SEQ ID NO: 166 - RNA, 22 nt, synthetic construct
  source 1..22: mol_type = other RNA
taacccaataaccaccacaagg

SEQ ID NO: 167 - RNA, 36 nt, synthetic construct
  source 1..36: mol_type = other RNA
tgtggtggttattgggttaagcagccgaaaggctgc

SEQ ID NO: 168 - RNA, 22 nt, synthetic construct
  source 1..22: mol_type = other RNA
ttaacccaataaccaccacagg

SEQ ID NO: 169 - RNA, 36 nt, synthetic construct
  source 1..36: mol_type = other RNA
gtggtggttattgggttagagcagccgaaaggctgc

SEQ ID NO: 170 - RNA, 22 nt, synthetic construct
  source 1..22: mol_type = other RNA
tctaacccaataaccaccacgg

SEQ ID NO: 171 - RNA, 36 nt, synthetic construct
  source 1..36: mol_type = other RNA
tggtggttattgggttagaagcagccgaaaggctgc

SEQ ID NO: 172 - RNA, 22 nt, synthetic construct
  source 1..22: mol_type = other RNA
ttctaacccaataaccaccagg

SEQ ID NO: 173 - RNA, 36 nt, synthetic construct
  source 1..36: mol_type = other RNA
ggtggttattgggttagagagcagccgaaaggctgc

SEQ ID NO: 174 - RNA, 22 nt, synthetic construct
  source 1..22: mol_type = other RNA
tctctaacccaataaccaccgg

SEQ ID NO: 175 - RNA, 36 nt, synthetic construct
  source 1..36: mol_type = other RNA
gtggttattgggttagagaagcagccgaaaggctgc

SEQ ID NO: 176 - RNA, 22 nt, synthetic construct
  source 1..22: mol_type = other RNA
ttctctaacccaataaccacgg

SEQ ID NO: 177 - RNA, 36 nt, synthetic construct
  source 1..36: mol_type = other RNA
tggttattgggttagagaaagcagccgaaaggctgc

SEQ ID NO: 178 - RNA, 22 nt, synthetic construct
  source 1..22: mol_type = other RNA
tttctctaacccaataaccagg

SEQ ID NO: 179 - RNA, 36 nt, synthetic construct
  source 1..36: mol_type = other RNA
ggttattgggttagagaatagcagccgaaaggctgc

SEQ ID NO: 180 - RNA, 22 nt, synthetic construct
  source 1..22: mol_type = other RNA
tattctctaacccaataaccgg

SEQ ID NO: 181 - RNA, 36 nt, synthetic construct
  source 1..36: mol_type = other RNA
gttattgggttagagaatgagcagccgaaaggctgc

SEQ ID NO: 182 - RNA, 22 nt, synthetic construct
  source 1..22: mol_type = other RNA
tcattctctaacccaataacgg

SEQ ID NO: 183 - RNA, 36 nt, synthetic construct
  source 1..36: mol_type = other RNA
ttattgggttagagaatgtagcagccgaaaggctgc

SEQ ID NO: 184 - RNA, 22 nt, synthetic construct
  source 1..22: mol_type = other RNA
tacattctctaacccaataagg

SEQ ID NO: 185 - RNA, 36 nt, synthetic construct
  source 1..36: mol_type = other RNA
attgggttagagaatgtgtagcagccgaaaggctgc

SEQ ID NO: 186 - RNA, 22 nt, synthetic construct
  source 1..22: mol_type = other RNA
tacacattctctaacccaatgg

SEQ ID NO: 187 - RNA, 36 nt, synthetic construct
  source 1..36: mol_type = other RNA
ttgggttagagaatgtgttagcagccgaaaggctgc

SEQ ID NO: 188 - RNA, 22 nt, synthetic construct
  source 1..22: mol_type = other RNA
taacacattctctaacccaagg

SEQ ID NO: 189 - RNA, 36 nt, synthetic construct
  source 1..36: mol_type = other RNA
ggttagagaatgtgttggtagcagccgaaaggctgc

SEQ ID NO: 190 - RNA, 22 nt, synthetic construct
  source 1..22: mol_type = other RNA
taccaacacattctctaaccgg

SEQ ID NO: 191 - RNA, 36 nt, synthetic construct
  source 1..36: mol_type = other RNA
gttagagaatgtgttggtgagcagccgaaaggctgc

SEQ ID NO: 192 - RNA, 22 nt, synthetic construct
  source 1..22: mol_type = other RNA
tcaccaacacattctctaacgg

SEQ ID NO: 193 - RNA, 36 nt, synthetic construct
  source 1..36: mol_type = other RNA
ttagagaatgtgttggtgcagcagccgaaaggctgc

SEQ ID NO: 194 - RNA, 22 nt, synthetic construct
  source 1..22: mol_type = other RNA
tgcaccaacacattctctaagg

SEQ ID NO: 195 - RNA, 36 nt, synthetic construct
  source 1..36: mol_type = other RNA
tagagaatgtgttggtgctagcagccgaaaggctgc

SEQ ID NO: 196 - RNA, 22 nt, synthetic construct
  source 1..22: mol_type = other RNA
tagcaccaacacattctctagg

SEQ ID NO: 197 - RNA, 36 nt, synthetic construct
  source 1..36: mol_type = other RNA
agagaatgtgttggtgctcagcagccgaaaggctgc

SEQ ID NO: 198 - RNA, 22 nt, synthetic construct
  source 1..22: mol_type = other RNA
tgagcaccaacacattctctgg

SEQ ID NO: 199 - RNA, 36 nt, synthetic construct
  source 1..36: mol_type = other RNA
gagaatgtgttggtgctcaagcagccgaaaggctgc

SEQ ID NO: 200 - RNA, 22 nt, synthetic construct
  source 1..22: mol_type = other RNA
ttgagcaccaacacattctcgg

SEQ ID NO: 201 - RNA, 36 nt, synthetic construct
  source 1..36: mol_type = other RNA
agaatgtgttggtgctcacagcagccgaaaggctgc

SEQ ID NO: 202 - RNA, 22 nt, synthetic construct
  source 1..22: mol_type = other RNA
tgtgagcaccaacacattctgg

SEQ ID NO: 203 - RNA, 36 nt, synthetic construct
  source 1..36: mol_type = other RNA
aatgtgttggtgctcaccaagcagccgaaaggctgc

SEQ ID NO: 204 - RNA, 22 nt, synthetic construct
  source 1..22: mol_type = other RNA
ttggtgagcaccaacacattgg

SEQ ID NO: 205 - RNA, 36 nt, synthetic construct
  source 1..36: mol_type = other RNA
atgtgttggtgctcaccaaagcagccgaaaggctgc

SEQ ID NO: 206 - RNA, 22 nt, synthetic construct
  source 1..22: mol_type = other RNA
tttggtgagcaccaacacatgg

SEQ ID NO: 207 - RNA, 36 nt, synthetic construct
  source 1..36: mol_type = other RNA
tgtgttggtgctcaccaagagcagccgaaaggctgc

SEQ ID NO: 208 - RNA, 22 nt, synthetic construct
  source 1..22: mol_type = other RNA
tcttggtgagcaccaacacagg

SEQ ID NO: 209 - RNA, 36 nt, synthetic construct
  source 1..36: mol_type = other RNA
tggtccatcatgaagaacaagcagccgaaaggctgc

SEQ ID NO: 210 - RNA, 22 nt, synthetic construct
  source 1..22: mol_type = other RNA
ttgttcttcatgatggaccagg

SEQ ID NO: 211 - RNA, 36 nt, synthetic construct
  source 1..36: mol_type = other RNA
ggtccatcatgaagaacatagcagccgaaaggctgc

SEQ ID NO: 212 - RNA, 22 nt, synthetic construct
  source 1..22: mol_type = other RNA
tatgttcttcatgatggaccgg

SEQ ID NO: 213 - RNA, 36 nt, synthetic construct
  source 1..36: mol_type = other RNA
ctgacttcttccttcagatagcagccgaaaggctgc

SEQ ID NO: 214 - RNA, 22 nt, synthetic construct
  source 1..22: mol_type = other RNA
tatctgaaggaagaagtcaggg

SEQ ID NO: 215 - RNA, 36 nt, synthetic construct
  source 1..36: mol_type = other RNA
acttcttccttcagatgctagcagccgaaaggctgc

SEQ ID NO: 216 - RNA, 22 nt, synthetic construct
  source 1..22: mol_type = other RNA
tagcatctgaaggaagaagtgg

SEQ ID NO: 217 - RNA, 36 nt, synthetic construct
  source 1..36: mol_type = other RNA
tccttcagatgctgtttttagcagccgaaaggctgc

SEQ ID NO: 218 - RNA, 22 nt, synthetic construct
  source 1..22: mol_type = other RNA
taaaaacagcatctgaaggagg

SEQ ID NO: 219 - RNA, 36 nt, synthetic construct
  source 1..36: mol_type = other RNA
ccttcagatgctgtttttcagcagccgaaaggctgc

SEQ ID NO: 220 - RNA, 22 nt, synthetic construct
  source 1..22: mol_type = other RNA
tgaaaaacagcatctgaagggg

SEQ ID NO: 221 - RNA, 36 nt, synthetic construct
  source 1..36: mol_type = other RNA
cttcagatgctgtttttcaagcagccgaaaggctgc

SEQ ID NO: 222 - RNA, 22 nt, synthetic construct
  source 1..22: mol_type = other RNA
ttgaaaaacagcatctgaaggg

SEQ ID NO: 223 - RNA, 36 nt, synthetic construct
  source 1..36: mol_type = other RNA
ttcagatgctgtttttcacagcagccgaaaggctgc

SEQ ID NO: 224 - RNA, 22 nt, synthetic construct
  source 1..22: mol_type = other RNA
tgtgaaaaacagcatctgaagg

SEQ ID NO: 225 - RNA, 36 nt, synthetic construct
  source 1..36: mol_type = other RNA
cagatgctgtttttcaccaagcagccgaaaggctgc

SEQ ID NO: 226 - RNA, 22 nt, synthetic construct
  source 1..22: mol_type = other RNA
ttggtgaaaaacagcatctggg

SEQ ID NO: 227 - RNA, 36 nt, synthetic construct
  source 1..36: mol_type = other RNA
agatgctgtttttcaccacagcagccgaaaggctgc

SEQ ID NO: 228 - RNA, 22 nt, synthetic construct
  source 1..22: mol_type = other RNA
tgtggtgaaaaacagcatctgg

SEQ ID NO: 229 - RNA, 36 nt, synthetic construct
  source 1..36: mol_type = other RNA
gatgctgtttttcaccactagcagccgaaaggctgc

SEQ ID NO: 230 - RNA, 22 nt, synthetic construct
  source 1..22: mol_type = other RNA
tagtggtgaaaaacagcatcgg

SEQ ID NO: 231 - RNA, 36 nt, synthetic construct
  source 1..36: mol_type = other RNA
atgctgtttttcaccactgagcagccgaaaggctgc

SEQ ID NO: 232 - RNA, 22 nt, synthetic construct
  source 1..22: mol_type = other RNA
tcagtggtgaaaaacagcatgg

SEQ ID NO: 233 - RNA, 36 nt, synthetic construct
  source 1..36: mol_type = other RNA
tgctgtttttcaccactgtagcagccgaaaggctgc

SEQ ID NO: 234 - RNA, 22 nt, synthetic construct
  source 1..22: mol_type = other RNA
tacagtggtgaaaaacagcagg

SEQ ID NO: 235 - RNA, 36 nt, synthetic construct
  source 1..36: mol_type = other RNA
gctgtttttcaccactgtcagcagccgaaaggctgc

SEQ ID NO: 236 - RNA, 22 nt, synthetic construct
  source 1..22: mol_type = other RNA
tgacagtggtgaaaaacagcgg

SEQ ID NO: 237 - RNA, 36 nt, synthetic construct
  source 1..36: mol_type = other RNA
tgtttttcaccactgtcctagcagccgaaaggctgc

SEQ ID NO: 238 - RNA, 22 nt, synthetic construct
  source 1..22: mol_type = other RNA
taggacagtggtgaaaaacagg

SEQ ID NO: 239 - RNA, 36 nt, synthetic construct
  source 1..36: mol_type = other RNA
gtttttcaccactgtcctgagcagccgaaaggctgc

SEQ ID NO: 240 - RNA, 22 nt, synthetic construct
  source 1..22: mol_type = other RNA
tcaggacagtggtgaaaaacgg

SEQ ID NO: 241 - RNA, 36 nt, synthetic construct
  source 1..36: mol_type = other RNA
tttttcaccactgtcctgtagcagccgaaaggctgc

SEQ ID NO: 242 - RNA, 22 nt, synthetic construct
  source 1..22: mol_type = other RNA
tacaggacagtggtgaaaaagg

SEQ ID NO: 243 - RNA, 36 nt, synthetic construct
  source 1..36: mol_type = other RNA
ttttcaccactgtcctgtcagcagccgaaaggctgc

SEQ ID NO: 244 - RNA, 22 nt, synthetic construct
  source 1..22: mol_type = other RNA
tgacaggacagtggtgaaaagg

SEQ ID NO: 245 - RNA, 36 nt, synthetic construct
  source 1..36: mol_type = other RNA
ttcaccactgtcctgtccaagcagccgaaaggctgc

SEQ ID NO: 246 - RNA, 22 nt, synthetic construct
  source 1..22: mol_type = other RNA
ttggacaggacagtggtgaagg

SEQ ID NO: 247 - RNA, 36 nt, synthetic construct
  source 1..36: mol_type = other RNA
caccactgtcctgtccattagcagccgaaaggctgc

SEQ ID NO: 248 - RNA, 22 nt, synthetic construct
  source 1..22: mol_type = other RNA
taatggacaggacagtggtggg

SEQ ID NO: 249 - RNA, 36 nt, synthetic construct
  source 1..36: mol_type = other RNA
accactgtcctgtccattgagcagccgaaaggctgc

SEQ ID NO: 250 - RNA, 22 nt, synthetic construct
  source 1..22: mol_type = other RNA
tcaatggacaggacagtggtgg

SEQ ID NO: 251 - RNA, 36 nt, synthetic construct
  source 1..36: mol_type = other RNA
ccactgtcctgtccattgaagcagccgaaaggctgc

SEQ ID NO: 252 - RNA, 22 nt, synthetic construct
  source 1..22: mol_type = other RNA
ttcaatggacaggacagtgggg

SEQ ID NO: 253 - RNA, 36 nt, synthetic construct
  source 1..36: mol_type = other RNA
cactgtcctgtccattgacagcagccgaaaggctgc

SEQ ID NO: 254 - RNA, 22 nt, synthetic construct
  source 1..22: mol_type = other RNA
tgtcaatggacaggacagtggg

SEQ ID NO: 255 - RNA, 36 nt, synthetic construct
  source 1..36: mol_type = other RNA
actgtcctgtccattgacaagcagccgaaaggctgc

SEQ ID NO: 256 - RNA, 22 nt, synthetic construct
  source 1..22: mol_type = other RNA
ttgtcaatggacaggacagtgg

SEQ ID NO: 257 - RNA, 36 nt, synthetic construct
  source 1..36: mol_type = other RNA
ctaagctacctgagaaccaagcagccgaaaggctgc

SEQ ID NO: 258 - RNA, 22 nt, synthetic construct
  source 1..22: mol_type = other RNA
ttggttctcaggtagcttaggg

SEQ ID NO: 259 - RNA, 36 nt, synthetic construct
  source 1..36: mol_type = other RNA
gaggtccagcagaggttgtagcagccgaaaggctgc

SEQ ID NO: 260 - RNA, 22 nt, synthetic construct
  source 1..22: mol_type = other RNA
tacaacctctgctggacctcgg

SEQ ID NO: 261 - RNA, 36 nt, synthetic construct
  source 1..36: mol_type = other RNA
gcagaggttgtccatgacaagcagccgaaaggctgc

SEQ ID NO: 262 - RNA, 22 nt, synthetic construct
  source 1..22: mol_type = other RNA
ttgtcatggacaacctctgcgg

SEQ ID NO: 263 - RNA, 36 nt, synthetic construct
  source 1..36: mol_type = other RNA
cagaggttgtccatgacagagcagccgaaaggctgc

SEQ ID NO: 264 - RNA, 22 nt, synthetic construct
  source 1..22: mol_type = other RNA
tctgtcatggacaacctctggg

SEQ ID NO: 265 - RNA, 36 nt, synthetic construct
  source 1..36: mol_type = other RNA
gaggatgaggaactttggaagcagccgaaaggctgc

SEQ ID NO: 266 - RNA, 22 nt, synthetic construct
  source 1..22: mol_type = other RNA
ttccaaagttcctcatcctcgg

SEQ ID NO: 267 - RNA, 36 nt, synthetic construct
  source 1..36: mol_type = other RNA
gaactttggaggaaattgtagcagccgaaaggctgc

SEQ ID NO: 268 - RNA, 22 nt, synthetic construct
  source 1..22: mol_type = other RNA
tacaatttcctccaaagttcgg

SEQ ID NO: 269 - RNA, 36 nt, synthetic construct
  source 1..36: mol_type = other RNA
gacgctcttcagctattacagcagccgaaaggctgc

SEQ ID NO: 270 - RNA, 22 nt, synthetic construct
  source 1..22: mol_type = other RNA
tgtaatagctgaagagcgtcgg

SEQ ID NO: 271 - RNA, 36 nt, synthetic construct
  source 1..36: mol_type = other RNA
acgctcttcagctattacaagcagccgaaaggctgc

SEQ ID NO: 272 - RNA, 22 nt, synthetic construct
  source 1..22: mol_type = other RNA
ttgtaatagctgaagagcgtgg

SEQ ID NO: 273 - RNA, 36 nt, synthetic construct
  source 1..36: mol_type = other RNA
cgctcttcagctattacaaagcagccgaaaggctgc

SEQ ID NO: 274 - RNA, 22 nt, synthetic construct
  source 1..22: mol_type = other RNA
tttgtaatagctgaagagcggg

SEQ ID NO: 275 - RNA, 36 nt, synthetic construct
  source 1..36: mol_type = other RNA
gctcttcagctattacaacagcagccgaaaggctgc

SEQ ID NO: 276 - RNA, 22 nt, synthetic construct
  source 1..22: mol_type = other RNA
tgttgtaatagctgaagagcgg

SEQ ID NO: 277 - RNA, 36 nt, synthetic construct
  source 1..36: mol_type = other RNA
ctcttcagctattacaacaagcagccgaaaggctgc

SEQ ID NO: 278 - RNA, 22 nt, synthetic construct
  source 1..22: mol_type = other RNA
ttgttgtaatagctgaagaggg

SEQ ID NO: 279 - RNA, 36 nt, synthetic construct
  source 1..36: mol_type = other RNA
tcttcagctattacaacatagcagccgaaaggctgc

SEQ ID NO: 280 - RNA, 22 nt, synthetic construct
  source 1..22: mol_type = other RNA
tatgttgtaatagctgaagagg

SEQ ID NO: 281 - RNA, 36 nt, synthetic construct
  source 1..36: mol_type = other RNA
cttcagctattacaacatcagcagccgaaaggctgc

SEQ ID NO: 282 - RNA, 22 nt, synthetic construct
  source 1..22: mol_type = other RNA
tgatgttgtaatagctgaaggg

SEQ ID NO: 283 - RNA, 36 nt, synthetic construct
  source 1..36: mol_type = other RNA
ttcagctattacaacatcaagcagccgaaaggctgc

SEQ ID NO: 284 - RNA, 22 nt, synthetic construct
  source 1..22: mol_type = other RNA
ttgatgttgtaatagctgaagg

SEQ ID NO: 285 - RNA, 36 nt, synthetic construct
  source 1..36: mol_type = other RNA
ccagcctgacctcacctgcagcagccgaaaggctgc

SEQ ID NO: 286 - RNA, 22 nt, synthetic construct
  source 1..22: mol_type = other RNA
tgcaggtgaggtcaggctgggg

SEQ ID NO: 287 - RNA, 36 nt, synthetic construct
  source 1..36: mol_type = other RNA
cagcctgacctcacctgctagcagccgaaaggctgc

SEQ ID NO: 288 - RNA, 22 nt, synthetic construct
  source 1..22: mol_type = other RNA
tagcaggtgaggtcaggctggg

SEQ ID NO: 289 - RNA, 36 nt, synthetic construct
  source 1..36: mol_type = other RNA
agcctgacctcacctgcttagcagccgaaaggctgc

SEQ ID NO: 290 - RNA, 22 nt, synthetic construct
  source 1..22: mol_type = other RNA
taagcaggtgaggtcaggctgg

SEQ ID NO: 291 - RNA, 36 nt, synthetic construct
  source 1..36: mol_type = other RNA
gcctgacctcacctgcttaagcagccgaaaggctgc

SEQ ID NO: 292 - RNA, 22 nt, synthetic construct
  source 1..22: mol_type = other RNA
ttaagcaggtgaggtcaggcgg

SEQ ID NO: 293 - RNA, 36 nt, synthetic construct
  source 1..36: mol_type = other RNA
cctgacctcacctgcttaaagcagccgaaaggctgc

SEQ ID NO: 294 - RNA, 22 nt, synthetic construct
  source 1..22: mol_type = other RNA
tttaagcaggtgaggtcagggg

SEQ ID NO: 295 - RNA, 36 nt, synthetic construct
  source 1..36: mol_type = other RNA
ctgacctcacctgcttaatagcagccgaaaggctgc

SEQ ID NO: 296 - RNA, 22 nt, synthetic construct
  source 1..22: mol_type = other RNA
tattaagcaggtgaggtcaggg

SEQ ID NO: 297 - RNA, 36 nt, synthetic construct
  source 1..36: mol_type = other RNA
tgacctcacctgcttaattagcagccgaaaggctgc

SEQ ID NO: 298 - RNA, 22 nt, synthetic construct
  source 1..22: mol_type = other RNA
taattaagcaggtgaggtcagg

SEQ ID NO: 299 - RNA, 36 nt, synthetic construct
  source 1..36: mol_type = other RNA
gacctcacctgcttaattgagcagccgaaaggctgc

SEQ ID NO: 300 - RNA, 22 nt, synthetic construct
  source 1..22: mol_type = other RNA
tcaattaagcaggtgaggtcgg

SEQ ID NO: 301 - RNA, 36 nt, synthetic construct
  source 1..36: mol_type = other RNA
acctcacctgcttaattgaagcagccgaaaggctgc

SEQ ID NO: 302 - RNA, 22 nt, synthetic construct
  source 1..22: mol_type = other RNA
ttcaattaagcaggtgaggtgg

SEQ ID NO: 303 - RNA, 36 nt, synthetic construct
  source 1..36: mol_type = other RNA
cctcacctgcttaattgacagcagccgaaaggctgc

SEQ ID NO: 304 - RNA, 22 nt, synthetic construct
  source 1..22: mol_type = other RNA
tgtcaattaagcaggtgagggg

SEQ ID NO: 305 - RNA, 36 nt, synthetic construct
  source 1..36: mol_type = other RNA
ctcacctgcttaattgacaagcagccgaaaggctgc

SEQ ID NO: 306 - RNA, 22 nt, synthetic construct
  source 1..22: mol_type = other RNA
ttgtcaattaagcaggtgaggg

SEQ ID NO: 307 - RNA, 36 nt, synthetic construct
  source 1..36: mol_type = other RNA
tcacctgcttaattgacacagcagccgaaaggctgc

SEQ ID NO: 308 - RNA, 22 nt, synthetic construct
  source 1..22: mol_type = other RNA
tgtgtcaattaagcaggtgagg

SEQ ID NO: 309 - RNA, 36 nt, synthetic construct
  source 1..36: mol_type = other RNA
cacctgcttaattgacaccagcagccgaaaggctgc

SEQ ID NO: 310 - RNA, 22 nt, synthetic construct
  source 1..22: mol_type = other RNA
tggtgtcaattaagcaggtggg

SEQ ID NO: 311 - RNA, 36 nt, synthetic construct
  source 1..36: mol_type = other RNA
acctgcttaattgacaccaagcagccgaaaggctgc

SEQ ID NO: 312 - RNA, 22 nt, synthetic construct
  source 1..22: mol_type = other RNA
ttggtgtcaattaagcaggtgg

SEQ ID NO: 313 - RNA, 36 nt, synthetic construct
  source 1..36: mol_type = other RNA
cctgcttaattgacaccaaagcagccgaaaggctgc

SEQ ID NO: 314 - RNA, 22 nt, synthetic construct
  source 1..22: mol_type = other RNA
tttggtgtcaattaagcagggg

SEQ ID NO: 315 - RNA, 36 nt, synthetic construct
  source 1..36: mol_type = other RNA
ctgcttaattgacaccaacagcagccgaaaggctgc

SEQ ID NO: 316 - RNA, 22 nt, synthetic construct
  source 1..22: mol_type = other RNA
tgttggtgtcaattaagcaggg

SEQ ID NO: 317 - RNA, 36 nt, synthetic construct
  source 1..36: mol_type = other RNA
tgcttaattgacaccaactagcagccgaaaggctgc

SEQ ID NO: 318 - RNA, 22 nt, synthetic construct
  source 1..22: mol_type = other RNA
tagttggtgtcaattaagcagg

SEQ ID NO: 319 - RNA, 36 nt, synthetic construct
  source 1..36: mol_type = other RNA
gcttaattgacaccaacttagcagccgaaaggctgc

SEQ ID NO: 320 - RNA, 22 nt, synthetic construct
  source 1..22: mol_type = other RNA
taagttggtgtcaattaagcgg

SEQ ID NO: 321 - RNA, 36 nt, synthetic construct
  source 1..36: mol_type = other RNA
cttaattgacaccaactttagcagccgaaaggctgc

SEQ ID NO: 322 - RNA, 22 nt, synthetic construct
  source 1..22: mol_type = other RNA
taaagttggtgtcaattaaggg

SEQ ID NO: 323 - RNA, 36 nt, synthetic construct
  source 1..36: mol_type = other RNA
ttaattgacaccaacttttagcagccgaaaggctgc

SEQ ID NO: 324 - RNA, 22 nt, synthetic construct
  source 1..22: mol_type = other RNA
taaaagttggtgtcaattaagg

SEQ ID NO: 325 - RNA, 36 nt, synthetic construct
  source 1..36: mol_type = other RNA
taattgacaccaacttttcagcagccgaaaggctgc

SEQ ID NO: 326 - RNA, 22 nt, synthetic construct
  source 1..22: mol_type = other RNA
tgaaaagttggtgtcaattagg

SEQ ID NO: 327 - RNA, 36 nt, synthetic construct
  source 1..36: mol_type = other RNA
attgaaggggtgctgtgctagcagccgaaaggctgc

SEQ ID NO: 328 - RNA, 22 nt, synthetic construct
  source 1..22: mol_type = other RNA
tagcacagcaccccttcaatgg

SEQ ID NO: 329 - RNA, 36 nt, synthetic construct
  source 1..36: mol_type = other RNA
cttggacaaaaggattgtgagcagccgaaaggctgc

SEQ ID NO: 330 - RNA, 22 nt, synthetic construct
  source 1..22: mol_type = other RNA
tcacaatccttttgtccaaggg

SEQ ID NO: 331 - RNA, 36 nt, synthetic construct
  source 1..36: mol_type = other RNA
ttggacaaaaggattgtggagcagccgaaaggctgc

SEQ ID NO: 332 - RNA, 22 nt, synthetic construct
  source 1..22: mol_type = other RNA
tccacaatccttttgtccaagg

SEQ ID NO: 333 - RNA, 36 nt, synthetic construct
  source 1..36: mol_type = other RNA
tcaacggttcccttgatttagcagccgaaaggctgc

SEQ ID NO: 334 - RNA, 22 nt, synthetic construct
  source 1..22: mol_type = other RNA
taaatcaagggaaccgttgagg

SEQ ID NO: 335 - RNA, 36 nt, synthetic construct
  source 1..36: mol_type = other RNA
caacggttcccttgatttcagcagccgaaaggctgc

SEQ ID NO: 336 - RNA, 22 nt, synthetic construct
  source 1..22: mol_type = other RNA
tgaaatcaagggaaccgttggg

SEQ ID NO: 337 - RNA, 36 nt, synthetic construct
  source 1..36: mol_type = other RNA
aacggttcccttgatttctagcagccgaaaggctgc

SEQ ID NO: 338 - RNA, 22 nt, synthetic construct
  source 1..22: mol_type = other RNA
tagaaatcaagggaaccgttgg

SEQ ID NO: 339 - RNA, 36 nt, synthetic construct
  source 1..36: mol_type = other RNA
acggttcccttgatttcttagcagccgaaaggctgc

SEQ ID NO: 340 - RNA, 22 nt, synthetic construct
  source 1..22: mol_type = other RNA
taagaaatcaagggaaccgtgg

SEQ ID NO: 341 - RNA, 36 nt, synthetic construct
  source 1..36: mol_type = other RNA
gtacattgaccagaccatgagcagccgaaaggctgc

SEQ ID NO: 342 - RNA, 22 nt, synthetic construct
  source 1..22: mol_type = other RNA
tcatggtctggtcaatgtacgg

SEQ ID NO: 343 - RNA, 36 nt, synthetic construct
  source 1..36: mol_type = other RNA
acctgtaccacctcctgtgagcagccgaaaggctgc

SEQ ID NO: 344 - RNA, 22 nt, synthetic construct
  source 1..22: mol_type = other RNA
tcacaggaggtggtacaggtgg

SEQ ID NO: 345 - RNA, 36 nt, synthetic construct
  source 1..36: mol_type = other RNA
cctgtaccacctcctgtgtagcagccgaaaggctgc

SEQ ID NO: 346 - RNA, 22 nt, synthetic construct
  source 1..22: mol_type = other RNA
tacacaggaggtggtacagggg

SEQ ID NO: 347 - RNA, 36 nt, synthetic construct
  source 1..36: mol_type = other RNA
gtaccacctcctgtgtcatagcagccgaaaggctgc

SEQ ID NO: 348 - RNA, 22 nt, synthetic construct
  source 1..22: mol_type = other RNA
tatgacacaggaggtggtacgg

SEQ ID NO: 349 - RNA, 36 nt, synthetic construct
  source 1..36: mol_type = other RNA
gcacaggcatcaagttctaagcagccgaaaggctgc

SEQ ID NO: 350 - RNA, 22 nt, synthetic construct
  source 1..22: mol_type = other RNA
ttagaacttgatgcctgtgcgg

SEQ ID NO: 351 - RNA, 36 nt, synthetic construct
  source 1..36: mol_type = other RNA
acaggcatcaagttctactagcagccgaaaggctgc

SEQ ID NO: 352 - RNA, 22 nt, synthetic construct
  source 1..22: mol_type = other RNA
tagtagaacttgatgcctgtgg

SEQ ID NO: 353 - RNA, 36 nt, synthetic construct
  source 1..36: mol_type = other RNA
caggcatcaagttctactcagcagccgaaaggctgc

SEQ ID NO: 354 - RNA, 22 nt, synthetic construct
  source 1..22: mol_type = other RNA
tgagtagaacttgatgcctggg

SEQ ID NO: 355 - RNA, 36 nt, synthetic construct
  source 1..36: mol_type = other RNA
aggcatcaagttctactccagcagccgaaaggctgc

SEQ ID NO: 356 - RNA, 22 nt, synthetic construct
  source 1..22: mol_type = other RNA
tggagtagaacttgatgcctgg

SEQ ID NO: 357 - RNA, 36 nt, synthetic construct
  source 1..36: mol_type = other RNA
ggcatcaagttctactccaagcagccgaaaggctgc

SEQ ID NO: 358 - RNA, 22 nt, synthetic construct
  source 1..22: mol_type = other RNA
ttggagtagaacttgatgccgg

SEQ ID NO: 359 - RNA, 36 nt, synthetic construct
  source 1..36: mol_type = other RNA
gcatcaagttctactccatagcagccgaaaggctgc

SEQ ID NO: 360 - RNA, 22 nt, synthetic construct
  source 1..22: mol_type = other RNA
tatggagtagaacttgatgcgg

SEQ ID NO: 361 - RNA, 36 nt, synthetic construct
  source 1..36: mol_type = other RNA
catcaagttctactccattagcagccgaaaggctgc

SEQ ID NO: 362 - RNA, 22 nt, synthetic construct
  source 1..22: mol_type = other RNA
taatggagtagaacttgatggg

SEQ ID NO: 363 - RNA, 36 nt, synthetic construct
  source 1..36: mol_type = other RNA
atcaagttctactccattcagcagccgaaaggctgc

SEQ ID NO: 364 - RNA, 22 nt, synthetic construct
  source 1..22: mol_type = other RNA
tgaatggagtagaacttgatgg

SEQ ID NO: 365 - RNA, 36 nt, synthetic construct
  source 1..36: mol_type = other RNA
tcaagttctactccattcaagcagccgaaaggctgc

SEQ ID NO: 366 - RNA, 22 nt, synthetic construct
  source 1..22: mol_type = other RNA
ttgaatggagtagaacttgagg

SEQ ID NO: 367 - RNA, 36 nt, synthetic construct
  source 1..36: mol_type = other RNA
caagttctactccattcagagcagccgaaaggctgc

SEQ ID NO: 368 - RNA, 22 nt, synthetic construct
  source 1..22: mol_type = other RNA
tctgaatggagtagaacttggg

SEQ ID NO: 369 - RNA, 36 nt, synthetic construct
  source 1..36: mol_type = other RNA
aagttctactccattcagcagcagccgaaaggctgc

SEQ ID NO: 370 - RNA, 22 nt, synthetic construct
  source 1..22: mol_type = other RNA
tgctgaatggagtagaacttgg

SEQ ID NO: 371 - RNA, 36 nt, synthetic construct
  source 1..36: mol_type = other RNA
agttctactccattcagcaagcagccgaaaggctgc

SEQ ID NO: 372 - RNA, 22 nt, synthetic construct
  source 1..22: mol_type = other RNA
ttgctgaatggagtagaactgg

SEQ ID NO: 373 - RNA, 36 nt, synthetic construct
  source 1..36: mol_type = other RNA
gttctactccattcagcagagcagccgaaaggctgc

SEQ ID NO: 374 - RNA, 22 nt, synthetic construct
  source 1..22: mol_type = other RNA
tctgctgaatggagtagaacgg

SEQ ID NO: 375 - RNA, 36 nt, synthetic construct
  source 1..36: mol_type = other RNA
gtgtcatctcagacaacctagcagccgaaaggctgc

SEQ ID NO: 376 - RNA, 22 nt, synthetic construct
  source 1..22: mol_type = other RNA
taggttgtctgagatgacacgg

SEQ ID NO: 377 - RNA, 36 nt, synthetic construct
  source 1..36: mol_type = other RNA
catctcagacaacctgctgagcagccgaaaggctgc

SEQ ID NO: 378 - RNA, 22 nt, synthetic construct
  source 1..22: mol_type = other RNA
tcagcaggttgtctgagatggg

SEQ ID NO: 379 - RNA, 36 nt, synthetic construct
  source 1..36: mol_type = other RNA
tcagacaacctgctggtgaagcagccgaaaggctgc

SEQ ID NO: 380 - RNA, 22 nt, synthetic construct
  source 1..22: mol_type = other RNA
ttcaccagcaggttgtctgagg

SEQ ID NO: 381 - RNA, 36 nt, synthetic construct
  source 1..36: mol_type = other RNA
cggggacctgttacagacaagcagccgaaaggctgc

SEQ ID NO: 382 - RNA, 22 nt, synthetic construct
  source 1..22: mol_type = other RNA
ttgtctgtaacaggtccccggg

SEQ ID NO: 383 - RNA, 36 nt, synthetic construct
  source 1..36: mol_type = other RNA
gacaacgctgccattgtctagcagccgaaaggctgc

SEQ ID NO: 384 - RNA, 22 nt, synthetic construct
  source 1..22: mol_type = other RNA
tagacaatggcagcgttgtcgg

SEQ ID NO: 385 - RNA, 36 nt, synthetic construct
  source 1..36: mol_type = other RNA
gctgcctcctgactgtaatagcagccgaaaggctgc

SEQ ID NO: 386 - RNA, 22 nt, synthetic construct
  source 1..22: mol_type = other RNA
tattacagtcaggaggcagcgg

SEQ ID NO: 387 - RNA, 36 nt, synthetic construct
  source 1..36: mol_type = other RNA
ctgcctcctgactgtaataagcagccgaaaggctgc

SEQ ID NO: 388 - RNA, 22 nt, synthetic construct
  source 1..22: mol_type = other RNA
ttattacagtcaggaggcaggg

SEQ ID NO: 389 - RNA, 36 nt, synthetic construct
  source 1..36: mol_type = other RNA
taatattaaacttttttaaagcagccgaaaggctgc

SEQ ID NO: 390 - RNA, 22 nt, synthetic construct
  source 1..22: mol_type = other RNA
tttaaaaaagtttaatattagg

SEQ ID NO: 391 - RNA, 36 nt, synthetic construct
  source 1..36: mol_type = other RNA
aatattaaacttttttaaaagcagccgaaaggctgc

SEQ ID NO: 392 - RNA, 22 nt, synthetic construct
  source 1..22: mol_type = other RNA
ttttaaaaaagtttaatattgg

SEQ ID NO: 393 - RNA, 36 nt, synthetic construct; identical to SEQ ID NO: 9
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 394 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taagtagatgtaggcaaacagg

SEQ ID NO: 395 - RNA, 36 nt, synthetic construct; identical to SEQ ID NO: 11
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 396 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgaagtagatgtaggcaaacgg

SEQ ID NO: 397 - RNA, 36 nt, synthetic construct; identical to SEQ ID NO: 13
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 398 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagaagtagatgtaggcaaagg

SEQ ID NO: 399 - RNA, 36 nt, synthetic construct; identical to SEQ ID NO: 15
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 400 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttggagaagtagatgtaggcgg

SEQ ID NO: 401 - RNA, 36 nt, synthetic construct; identical to SEQ ID NO: 17
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 402 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacttgaccatgtcgatcttgg

SEQ ID NO: 403 - RNA, 36 nt, synthetic construct; identical to SEQ ID NO: 19
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 404 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgacttgaccatgtcgatctgg

SEQ ID NO: 405 - RNA, 36 nt, synthetic construct; identical to SEQ ID NO: 21
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 406 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttggacttgaccatgtcgatgg

SEQ ID NO: 407 - RNA, 36 nt, synthetic construct; identical to SEQ ID NO: 23
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 408 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacttggtgagcaccaacacgg

SEQ ID NO: 409 - RNA, 36 nt, synthetic construct; identical to SEQ ID NO: 25
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 410 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgacttggtgagcaccaacagg

SEQ ID NO: 411 - RNA, 36 nt, synthetic construct; identical to SEQ ID NO: 27
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 412 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttcatgatggaccagctctcgg

SEQ ID NO: 413 - RNA, 36 nt, synthetic construct; identical to SEQ ID NO: 29
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 414 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tttcatgatggaccagctctgg

SEQ ID NO: 415 - RNA, 36 nt, synthetic construct; identical to SEQ ID NO: 31
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 416 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcttcatgatggaccagctcgg

SEQ ID NO: 417 - RNA, 36 nt, synthetic construct; identical to SEQ ID NO: 33
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 418 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttcttcatgatggaccagctgg

SEQ ID NO: 419 - RNA, 36 nt, synthetic construct; identical to SEQ ID NO: 35
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 420 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tttcttcatgatggaccagcgg

SEQ ID NO: 421 - RNA, 36 nt, synthetic construct; identical to SEQ ID NO: 37
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 422 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgttcttcatgatggaccaggg

SEQ ID NO: 423 - RNA, 36 nt, synthetic construct; identical to SEQ ID NO: 39
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 424 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatgccaatccagacaacgggg

SEQ ID NO: 425 - RNA, 36 nt, synthetic construct; identical to SEQ ID NO: 41
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 426 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taggatgccaatccagacaagg

SEQ ID NO: 427 - RNA, 36 nt, synthetic construct; identical to SEQ ID NO: 43
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 428 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaggatgccaatccagacagg

SEQ ID NO: 429 - RNA, 36 nt, synthetic construct; identical to SEQ ID NO: 45
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 430 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tccaggatgccaatccagacgg

SEQ ID NO: 431 - RNA, 36 nt, synthetic construct; identical to SEQ ID NO: 47
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 432 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttaccaggatgccaatccaggg

SEQ ID NO: 433 - RNA, 36 nt, synthetic construct; identical to SEQ ID NO: 49
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 434 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tataccaggatgccaatccagg

SEQ ID NO: 435 - RNA, 36 nt, synthetic construct; identical to SEQ ID NO: 51
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 436 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttataccaggatgccaatccgg

SEQ ID NO: 437 - RNA, 36 nt, synthetic construct; identical to SEQ ID NO: 53
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 438 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgtataccaggatgccaatcgg

SEQ ID NO: 439 - RNA, 36 nt, synthetic construct; identical to SEQ ID NO: 55
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 440 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgtataccaggatgccaatgg

SEQ ID NO: 441 - RNA, 36 nt, synthetic construct; identical to SEQ ID NO: 57
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 442 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatcaggtgggaagatggaggg

SEQ ID NO: 443 - RNA, 36 nt, synthetic construct; identical to SEQ ID NO: 59
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 444 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttacatcccacaggcagatggg

SEQ ID NO: 445 - RNA, 36 nt, synthetic construct; identical to SEQ ID NO: 61
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 446 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagtacatcccacaggcagagg

SEQ ID NO: 447 - RNA, 36 nt, synthetic construct; identical to SEQ ID NO: 63
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 448 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacacccaagcttgcaccacgg

SEQ ID NO: 449 - RNA, 36 nt, synthetic construct; identical to SEQ ID NO: 65
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 450 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgacacccaagcttgcaccagg

SEQ ID NO: 451 - RNA, 36 nt, synthetic construct; identical to SEQ ID NO: 67
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 452 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgacacccaagcttgcaccgg

SEQ ID NO: 453 - RNA, 36 nt, synthetic construct; identical to SEQ ID NO: 69
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 454 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatgacacccaagcttgcacgg

SEQ ID NO: 455 - RNA, 36 nt, synthetic construct; identical to SEQ ID NO: 71
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 456 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagatgacacccaagcttgcgg

SEQ ID NO: 457 - RNA, 36 nt, synthetic construct; identical to SEQ ID NO: 73
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 458 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgagatgacacccaagcttggg

SEQ ID NO: 459 - RNA, 36 nt, synthetic construct; identical to SEQ ID NO: 75
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 460 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgagatgacacccaagcttgg

SEQ ID NO: 461 - RNA, 36 nt, synthetic construct; identical to SEQ ID NO: 77
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 462 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tctgagatgacacccaagctgg

SEQ ID NO: 463 - RNA, 36 nt, synthetic construct; identical to SEQ ID NO: 79
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 464 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttctgagatgacacccaagcgg

SEQ ID NO: 465 - RNA, 36 nt, synthetic construct; identical to SEQ ID NO: 81
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 466 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taggtcccaaaaggagacacgg

SEQ ID NO: 467 - RNA, 36 nt, synthetic construct; identical to SEQ ID NO: 83
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 468 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttaggtcccaaaaggagacagg

SEQ ID NO: 469 - RNA, 36 nt, synthetic construct; identical to SEQ ID NO: 85
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 470 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tctgtctgtaacaggtccccgg

SEQ ID NO: 471 - RNA, 36 nt, synthetic construct; identical to SEQ ID NO: 87
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 472 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tactgtctgtaacaggtcccgg

SEQ ID NO: 473 - RNA, 36 nt, synthetic construct; identical to SEQ ID NO: 89
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 474 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgactgtctgtaacaggtccgg

SEQ ID NO: 475 - RNA, 36 nt, synthetic construct; identical to SEQ ID NO: 91
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 476 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagactgtctgtaacaggtcgg

SEQ ID NO: 477 - RNA, 36 nt, synthetic construct; identical to SEQ ID NO: 93
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 478 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttagactgtctgtaacaggtgg

SEQ ID NO: 479 - RNA, 36 nt, synthetic construct; identical to SEQ ID NO: 95
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 480 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taaagttgcagacaatggcagg

SEQ ID NO: 481 - RNA, 36 nt, synthetic construct; identical to SEQ ID NO: 97
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 482 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaaagttgcagacaatggcgg

SEQ ID NO: 483 - RNA, 36 nt, synthetic construct; identical to SEQ ID NO: 99
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 484 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tccaaagttgcagacaatgggg

SEQ ID NO: 485 - RNA, 36 nt, synthetic construct; identical to SEQ ID NO: 101
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 486 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgccaaagttgcagacaatgg

SEQ ID NO: 487 - RNA, 36 nt, synthetic construct; identical to SEQ ID NO: 103
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 488 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttcactgccaaagttgcagagg

SEQ ID NO: 489 - RNA, 36 nt, synthetic construct; identical to SEQ ID NO: 105
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 490 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgagtttcagcagtgggtaggg

SEQ ID NO: 491 - RNA, 36 nt, synthetic construct; identical to SEQ ID NO: 107
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 492 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcacaggtcctgttcctggcgg

SEQ ID NO: 493 - RNA, 36 nt, synthetic construct; identical to SEQ ID NO: 109
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 494 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taattccacaggtcctgttcgg

SEQ ID NO: 495 - RNA, 36 nt, synthetic construct; identical to SEQ ID NO: 111
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 496 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgaattccacaggtcctgtgg

SEQ ID NO: 497 - RNA, 36 nt, synthetic construct; identical to SEQ ID NO: 113
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 498 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacaggggtggtgaattccagg

SEQ ID NO: 499 - RNA, 36 nt, synthetic construct; identical to SEQ ID NO: 115
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 500 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgatgtaggtggtcacaaggg

SEQ ID NO: 501 - RNA, 36 nt, synthetic construct; identical to SEQ ID NO: 117
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 502 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatgatgtaggtggtcacaagg

SEQ ID NO: 503 - RNA, 36 nt, synthetic construct; identical to SEQ ID NO: 119
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 504 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgatgatgtaggtggtcacagg

SEQ ID NO: 505 - RNA, 36 nt, synthetic construct; identical to SEQ ID NO: 121
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 506 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagatgatgtaggtggtcacgg

SEQ ID NO: 507 - RNA, 36 nt, synthetic construct; identical to SEQ ID NO: 123
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 508 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taagatgatgtaggtggtcagg

SEQ ID NO: 509 - RNA, 36 nt, synthetic construct; identical to SEQ ID NO: 125
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 510 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaagatgatgtaggtggtcgg

SEQ ID NO: 511 - RNA, 36 nt, synthetic construct; identical to SEQ ID NO: 127
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 512 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacaagatgatgtaggtggtgg

SEQ ID NO: 513 - RNA, 36 nt, synthetic construct; identical to SEQ ID NO: 129
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 514 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taacaagatgatgtaggtgggg

SEQ ID NO: 515 - RNA, 36 nt, synthetic construct; identical to SEQ ID NO: 131
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 516 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taaacaagatgatgtaggtggg

SEQ ID NO: 517 - RNA, 36 nt, synthetic construct; identical to SEQ ID NO: 133
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 518 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaaacaagatgatgtaggtgg

SEQ ID NO: 519 - RNA, 36 nt, synthetic construct; identical to SEQ ID NO: 135
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 520 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgcaaacaagatgatgtagggg

SEQ ID NO: 521 - RNA, 36 nt, synthetic construct; identical to SEQ ID NO: 137
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 522 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tggcaaacaagatgatgtaggg

SEQ ID NO: 523 - RNA, 36 nt, synthetic construct; identical to SEQ ID NO: 139
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 524 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttaggcaaacaagatgatgtgg

SEQ ID NO: 525 - RNA, 36 nt, synthetic construct; identical to SEQ ID NO: 141
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 526 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgtaggcaaacaagatgatgg

SEQ ID NO: 527 - RNA, 36 nt, synthetic construct; identical to SEQ ID NO: 143
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 528 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatgtaggcaaacaagatgagg

SEQ ID NO: 529 - RNA, 36 nt, synthetic construct; identical to SEQ ID NO: 145
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 530 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagatgtaggcaaacaagatgg

SEQ ID NO: 531 - RNA, 36 nt, synthetic construct; identical to SEQ ID NO: 147
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 532 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttagatgtaggcaaacaagagg

SEQ ID NO: 533 - RNA, 36 nt, synthetic construct; identical to SEQ ID NO: 149
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 534 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaccacaaggtaggggaaagg

SEQ ID NO: 535 - RNA, 36 nt, synthetic construct; identical to SEQ ID NO: 151
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 536 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tccaccacaaggtaggggaagg

SEQ ID NO: 537 - RNA, 36 nt, synthetic construct; identical to SEQ ID NO: 153
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 538 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttaaccaccacaaggtaggggg

SEQ ID NO: 539 - RNA, 36 nt, synthetic construct; identical to SEQ ID NO: 155
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 540 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taataaccaccacaaggtaggg

SEQ ID NO: 541 - RNA, 36 nt, synthetic construct; identical to SEQ ID NO: 157
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 542 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaataaccaccacaaggtagg

SEQ ID NO: 543 - RNA, 36 nt, synthetic construct; identical to SEQ ID NO: 159
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 544 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tccaataaccaccacaaggtgg

SEQ ID NO: 545 - RNA, 36 nt, synthetic construct; identical to SEQ ID NO: 161
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 546 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcccaataaccaccacaagggg

SEQ ID NO: 547 - RNA, 36 nt, synthetic construct; identical to SEQ ID NO: 163
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 548 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacccaataaccaccacaaggg

SEQ ID NO: 549 - RNA, 36 nt, synthetic construct; identical to SEQ ID NO: 165
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 550 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taacccaataaccaccacaagg

SEQ ID NO: 551 - RNA, 36 nt, synthetic construct; identical to SEQ ID NO: 167
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 552 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttaacccaataaccaccacagg

SEQ ID NO: 553 - RNA, 36 nt, synthetic construct; identical to SEQ ID NO: 169
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 554 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tctaacccaataaccaccacgg

SEQ ID NO: 555 - RNA, 36 nt, synthetic construct; identical to SEQ ID NO: 171
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 556 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttctaacccaataaccaccagg

SEQ ID NO: 557 - RNA, 36 nt, synthetic construct; identical to SEQ ID NO: 173
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 558 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tctctaacccaataaccaccgg

SEQ ID NO: 559 - RNA, 36 nt, synthetic construct; identical to SEQ ID NO: 175
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 560 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttctctaacccaataaccacgg

SEQ ID NO: 561 - RNA, 36 nt, synthetic construct; identical to SEQ ID NO: 177
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 562 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tttctctaacccaataaccagg

SEQ ID NO: 563 - RNA, 36 nt, synthetic construct; identical to SEQ ID NO: 179
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 564 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tattctctaacccaataaccgg

SEQ ID NO: 565 - RNA, 36 nt, synthetic construct; identical to SEQ ID NO: 181
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 566 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcattctctaacccaataacgg

SEQ ID NO: 567 - RNA, 36 nt, synthetic construct; identical to SEQ ID NO: 183
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 568 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacattctctaacccaataagg

SEQ ID NO: 569 - RNA, 36 nt, synthetic construct; identical to SEQ ID NO: 185
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 570 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacacattctctaacccaatgg

SEQ ID NO: 571 - RNA, 36 nt, synthetic construct; identical to SEQ ID NO: 187
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 572 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taacacattctctaacccaagg

SEQ ID NO: 573 - RNA, 36 nt, synthetic construct; identical to SEQ ID NO: 189
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 574 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taccaacacattctctaaccgg

SEQ ID NO: 575 - RNA, 36 nt, synthetic construct; identical to SEQ ID NO: 191
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 576 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaccaacacattctctaacgg

SEQ ID NO: 577 - RNA, 36 nt, synthetic construct; identical to SEQ ID NO: 193
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 578 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgcaccaacacattctctaagg

SEQ ID NO: 579 - RNA, 36 nt, synthetic construct; identical to SEQ ID NO: 195
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 580 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagcaccaacacattctctagg

SEQ ID NO: 581 - RNA, 36 nt, synthetic construct; identical to SEQ ID NO: 197
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 582 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgagcaccaacacattctctgg

SEQ ID NO: 583 - RNA, 36 nt, synthetic construct; identical to SEQ ID NO: 199
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 584 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgagcaccaacacattctcgg

SEQ ID NO: 585 - RNA, 36 nt, synthetic construct; identical to SEQ ID NO: 201
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 586 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgtgagcaccaacacattctgg

SEQ ID NO: 587 - RNA, 36 nt, synthetic construct; identical to SEQ ID NO: 203
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 588 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttggtgagcaccaacacattgg

SEQ ID NO: 589 - RNA, 36 nt, synthetic construct; identical to SEQ ID NO: 205
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 590 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tttggtgagcaccaacacatgg

SEQ ID NO: 591 - RNA, 36 nt, synthetic construct; identical to SEQ ID NO: 207
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 592 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcttggtgagcaccaacacagg

SEQ ID NO: 593 - RNA, 36 nt, synthetic construct; identical to SEQ ID NO: 209
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 594 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgttcttcatgatggaccagg

SEQ ID NO: 595 - RNA, 36 nt, synthetic construct; identical to SEQ ID NO: 211
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 596 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatgttcttcatgatggaccgg

SEQ ID NO: 597 - RNA, 36 nt, synthetic construct; identical to SEQ ID NO: 213
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 598 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatctgaaggaagaagtcaggg

SEQ ID NO: 599 - RNA, 36 nt, synthetic construct; identical to SEQ ID NO: 215
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 600 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagcatctgaaggaagaagtgg

SEQ ID NO: 601 - RNA, 36 nt, synthetic construct; identical to SEQ ID NO: 217
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 602 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taaaaacagcatctgaaggagg

SEQ ID NO: 603 - RNA, 36 nt, synthetic construct; identical to SEQ ID NO: 219
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 604 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgaaaaacagcatctgaagggg

SEQ ID NO: 605 - RNA, 36 nt, synthetic construct; identical to SEQ ID NO: 221
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 606 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgaaaaacagcatctgaaggg

SEQ ID NO: 607 - RNA, 36 nt, synthetic construct; identical to SEQ ID NO: 223
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 608 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgtgaaaaacagcatctgaagg

SEQ ID NO: 609 - RNA, 36 nt, synthetic construct; identical to SEQ ID NO: 225
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 610 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttggtgaaaaacagcatctggg

SEQ ID NO: 611 - RNA, 36 nt, synthetic construct; identical to SEQ ID NO: 227
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 612 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgtggtgaaaaacagcatctgg

SEQ ID NO: 613 - RNA, 36 nt, synthetic construct; identical to SEQ ID NO: 229
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 614 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagtggtgaaaaacagcatcgg

SEQ ID NO: 615 - RNA, 36 nt, synthetic construct; identical to SEQ ID NO: 231
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 616 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcagtggtgaaaaacagcatgg

SEQ ID NO: 617 - RNA, 36 nt, synthetic construct; identical to SEQ ID NO: 233
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 618 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacagtggtgaaaaacagcagg

SEQ ID NO: 619 - RNA, 36 nt, synthetic construct; identical to SEQ ID NO: 235
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 620 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgacagtggtgaaaaacagcgg

SEQ ID NO: 621 - RNA, 36 nt, synthetic construct; identical to SEQ ID NO: 237
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 622 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taggacagtggtgaaaaacagg

SEQ ID NO: 623 - RNA, 36 nt, synthetic construct; identical to SEQ ID NO: 239
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 624 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaggacagtggtgaaaaacgg

SEQ ID NO: 625 - RNA, 36 nt, synthetic construct; identical to SEQ ID NO: 241
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 626 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacaggacagtggtgaaaaagg

SEQ ID NO: 627 - RNA, 36 nt, synthetic construct; identical to SEQ ID NO: 243
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 628 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgacaggacagtggtgaaaagg

SEQ ID NO: 629 - RNA, 36 nt, synthetic construct; identical to SEQ ID NO: 245
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 630 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttggacaggacagtggtgaagg

SEQ ID NO: 631 - RNA, 36 nt, synthetic construct; identical to SEQ ID NO: 247
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 632 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taatggacaggacagtggtggg

SEQ ID NO: 633 - RNA, 36 nt, synthetic construct; identical to SEQ ID NO: 249
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 634 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaatggacaggacagtggtgg

SEQ ID NO: 635 - RNA, 36 nt, synthetic construct; identical to SEQ ID NO: 251
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 636 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttcaatggacaggacagtgggg

SEQ ID NO: 637 - RNA, 36 nt, synthetic construct; identical to SEQ ID NO: 253
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 638 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgtcaatggacaggacagtggg

SEQ ID NO: 639 - RNA, 36 nt, synthetic construct; identical to SEQ ID NO: 255
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 640 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgtcaatggacaggacagtgg

SEQ ID NO: 641 - RNA, 36 nt, synthetic construct; identical to SEQ ID NO: 257
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 642 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttggttctcaggtagcttaggg

SEQ ID NO: 643 - RNA, 36 nt, synthetic construct; identical to SEQ ID NO: 259
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 644 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacaacctctgctggacctcgg

SEQ ID NO: 645 - RNA, 36 nt, synthetic construct; identical to SEQ ID NO: 261
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 646 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgtcatggacaacctctgcgg

SEQ ID NO: 647 - RNA, 36 nt, synthetic construct; identical to SEQ ID NO: 263
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 648 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tctgtcatggacaacctctggg

SEQ ID NO: 649 - RNA, 36 nt, synthetic construct; identical to SEQ ID NO: 265
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 650 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttccaaagttcctcatcctcgg

SEQ ID NO: 651 - RNA, 36 nt, synthetic construct; identical to SEQ ID NO: 267
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 652 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacaatttcctccaaagttcgg

SEQ ID NO: 653 - RNA, 36 nt, synthetic construct; identical to SEQ ID NO: 269
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 654 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgtaatagctgaagagcgtcgg

SEQ ID NO: 655 - RNA, 36 nt, synthetic construct; identical to SEQ ID NO: 271
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 656 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgtaatagctgaagagcgtgg

SEQ ID NO: 657 - RNA, 36 nt, synthetic construct; identical to SEQ ID NO: 273
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 658 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tttgtaatagctgaagagcggg

SEQ ID NO: 659 - RNA, 36 nt, synthetic construct; identical to SEQ ID NO: 275
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 660 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgttgtaatagctgaagagcgg

SEQ ID NO: 661 - RNA, 36 nt, synthetic construct; identical to SEQ ID NO: 277
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 662 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgttgtaatagctgaagaggg

SEQ ID NO: 663 - RNA, 36 nt, synthetic construct; identical to SEQ ID NO: 279
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 664 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatgttgtaatagctgaagagg

SEQ ID NO: 665 - RNA, 36 nt, synthetic construct; identical to SEQ ID NO: 281
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 666 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgatgttgtaatagctgaaggg

SEQ ID NO: 667 - RNA, 36 nt, synthetic construct; identical to SEQ ID NO: 283
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 668 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgatgttgtaatagctgaagg

SEQ ID NO: 669 - RNA, 36 nt, synthetic construct; identical to SEQ ID NO: 285
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 670 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgcaggtgaggtcaggctgggg

SEQ ID NO: 671 - RNA, 36 nt, synthetic construct; identical to SEQ ID NO: 287
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 672 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagcaggtgaggtcaggctggg

SEQ ID NO: 673 - RNA, 36 nt, synthetic construct; identical to SEQ ID NO: 289
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 674 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taagcaggtgaggtcaggctgg

SEQ ID NO: 675 - RNA, 36 nt, synthetic construct; identical to SEQ ID NO: 291
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 676 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttaagcaggtgaggtcaggcgg

SEQ ID NO: 677 - RNA, 36 nt, synthetic construct; identical to SEQ ID NO: 293
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 678 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tttaagcaggtgaggtcagggg

SEQ ID NO: 679 - RNA, 36 nt, synthetic construct; identical to SEQ ID NO: 295
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 680 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tattaagcaggtgaggtcaggg

SEQ ID NO: 681 - RNA, 36 nt, synthetic construct; identical to SEQ ID NO: 297
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 682 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taattaagcaggtgaggtcagg

SEQ ID NO: 683 - RNA, 36 nt, synthetic construct; identical to SEQ ID NO: 299
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 684 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcaattaagcaggtgaggtcgg

SEQ ID NO: 685 - RNA, 36 nt, synthetic construct; identical to SEQ ID NO: 301
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 686 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttcaattaagcaggtgaggtgg

SEQ ID NO: 687 - RNA, 36 nt, synthetic construct; identical to SEQ ID NO: 303
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 688 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgtcaattaagcaggtgagggg

SEQ ID NO: 689 - RNA, 36 nt, synthetic construct; identical to SEQ ID NO: 305
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 690 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgtcaattaagcaggtgaggg

SEQ ID NO: 691 - RNA, 36 nt, synthetic construct; identical to SEQ ID NO: 307
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 692 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgtgtcaattaagcaggtgagg

SEQ ID NO: 693 - RNA, 36 nt, synthetic construct; identical to SEQ ID NO: 309
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 694 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tggtgtcaattaagcaggtggg

SEQ ID NO: 695 - RNA, 36 nt, synthetic construct; identical to SEQ ID NO: 311
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 696 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttggtgtcaattaagcaggtgg

SEQ ID NO: 697 - RNA, 36 nt, synthetic construct; identical to SEQ ID NO: 313
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 698 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tttggtgtcaattaagcagggg

SEQ ID NO: 699 - RNA, 36 nt, synthetic construct; identical to SEQ ID NO: 315
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 700 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgttggtgtcaattaagcaggg

SEQ ID NO: 701 - RNA, 36 nt, synthetic construct; identical to SEQ ID NO: 317
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 702 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagttggtgtcaattaagcagg

SEQ ID NO: 703 - RNA, 36 nt, synthetic construct; identical to SEQ ID NO: 319
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 704 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taagttggtgtcaattaagcgg

SEQ ID NO: 705 - RNA, 36 nt, synthetic construct; identical to SEQ ID NO: 321
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 706 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taaagttggtgtcaattaaggg

SEQ ID NO: 707 - RNA, 36 nt, synthetic construct; identical to SEQ ID NO: 323
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 708 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taaaagttggtgtcaattaagg

SEQ ID NO: 709 - RNA, 36 nt, synthetic construct; identical to SEQ ID NO: 325
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 710 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgaaaagttggtgtcaattagg

SEQ ID NO: 711 - RNA, 36 nt, synthetic construct; identical to SEQ ID NO: 327
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 712 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagcacagcaccccttcaatgg

SEQ ID NO: 713 - RNA, 36 nt, synthetic construct; identical to SEQ ID NO: 329
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 714 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcacaatccttttgtccaaggg

SEQ ID NO: 715 - RNA, 36 nt, synthetic construct; identical to SEQ ID NO: 331
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 716 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tccacaatccttttgtccaagg

SEQ ID NO: 717 - RNA, 36 nt, synthetic construct; identical to SEQ ID NO: 333
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 718 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taaatcaagggaaccgttgagg

SEQ ID NO: 719 - RNA, 36 nt, synthetic construct; identical to SEQ ID NO: 335
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 720 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgaaatcaagggaaccgttggg

SEQ ID NO: 721 - RNA, 36 nt, synthetic construct; identical to SEQ ID NO: 337
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 722 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagaaatcaagggaaccgttgg

SEQ ID NO: 723 - RNA, 36 nt, synthetic construct; identical to SEQ ID NO: 339
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 724 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taagaaatcaagggaaccgtgg

SEQ ID NO: 725 - RNA, 36 nt, synthetic construct; identical to SEQ ID NO: 341
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 726 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcatggtctggtcaatgtacgg

SEQ ID NO: 727 - RNA, 36 nt, synthetic construct; identical to SEQ ID NO: 343
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 728 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcacaggaggtggtacaggtgg

SEQ ID NO: 729 - RNA, 36 nt, synthetic construct; identical to SEQ ID NO: 345
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 730 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tacacaggaggtggtacagggg

SEQ ID NO: 731 - RNA, 36 nt, synthetic construct; identical to SEQ ID NO: 347
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 732 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatgacacaggaggtggtacgg

SEQ ID NO: 733 - RNA, 36 nt, synthetic construct; identical to SEQ ID NO: 349
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 734 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttagaacttgatgcctgtgcgg

SEQ ID NO: 735 - RNA, 36 nt, synthetic construct; identical to SEQ ID NO: 351
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 736 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagtagaacttgatgcctgtgg

SEQ ID NO: 737 - RNA, 36 nt, synthetic construct; identical to SEQ ID NO: 353
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 738 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgagtagaacttgatgcctggg

SEQ ID NO: 739 - RNA, 36 nt, synthetic construct; identical to SEQ ID NO: 355
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 740 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tggagtagaacttgatgcctgg

SEQ ID NO: 741 - RNA, 36 nt, synthetic construct; identical to SEQ ID NO: 357
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 742 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttggagtagaacttgatgccgg

SEQ ID NO: 743 - RNA, 36 nt, synthetic construct; identical to SEQ ID NO: 359
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 744 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tatggagtagaacttgatgcgg

SEQ ID NO: 745 - RNA, 36 nt, synthetic construct; identical to SEQ ID NO: 361
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 746 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taatggagtagaacttgatggg

SEQ ID NO: 747 - RNA, 36 nt, synthetic construct; identical to SEQ ID NO: 363
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 748 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgaatggagtagaacttgatgg

SEQ ID NO: 749 - RNA, 36 nt, synthetic construct; identical to SEQ ID NO: 365
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 750 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgaatggagtagaacttgagg

SEQ ID NO: 751 - RNA, 36 nt, synthetic construct; identical to SEQ ID NO: 367
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 752 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tctgaatggagtagaacttggg

SEQ ID NO: 753 - RNA, 36 nt, synthetic construct; identical to SEQ ID NO: 369
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 754 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tgctgaatggagtagaacttgg

SEQ ID NO: 755 - RNA, 36 nt, synthetic construct; identical to SEQ ID NO: 371
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 756 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgctgaatggagtagaactgg

SEQ ID NO: 757 - RNA, 36 nt, synthetic construct; identical to SEQ ID NO: 373
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 758 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tctgctgaatggagtagaacgg

SEQ ID NO: 759 - RNA, 36 nt, synthetic construct; identical to SEQ ID NO: 375
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 760 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
taggttgtctgagatgacacgg

SEQ ID NO: 761 - RNA, 36 nt, synthetic construct; identical to SEQ ID NO: 377
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 762 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tcagcaggttgtctgagatggg

SEQ ID NO: 763 - RNA, 36 nt, synthetic construct; identical to SEQ ID NO: 379
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 764 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttcaccagcaggttgtctgagg

SEQ ID NO: 765 - RNA, 36 nt, synthetic construct; identical to SEQ ID NO: 381
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 766 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttgtctgtaacaggtccccggg

SEQ ID NO: 767 - RNA, 36 nt, synthetic construct; identical to SEQ ID NO: 383
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 768 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tagacaatggcagcgttgtcgg

SEQ ID NO: 769 - RNA, 36 nt, synthetic construct; identical to SEQ ID NO: 385
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 770 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tattacagtcaggaggcagcgg

SEQ ID NO: 771 - RNA, 36 nt, synthetic construct; identical to SEQ ID NO: 387
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 772 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttattacagtcaggaggcaggg

SEQ ID NO: 773 - RNA, 36 nt, synthetic construct; identical to SEQ ID NO: 389
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 774 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
tttaaaaaagtttaatattagg

SEQ ID NO: 775 - RNA, 36 nt, synthetic construct; identical to SEQ ID NO: 391
  source 1..36: mol_type = other RNA
  modified_base 1: mod_base = OTHER; note = 2'-O-methyl nucleotide phosphorothioate
  modified_base 2: mod_base = OTHER; note = 2'-O-methyl nucleotide
  modified_base 3: mod_base = OTHER; note = 2'-O-methyl nucleotide
  modified_base 4: mod_base = OTHER; note = 2'-O-methyl nucleotide
  modified_base 5: mod_base = OTHER; note = 2'-O-methyl nucleotide
  modified_base 6: mod_base = OTHER; note = 2'-O-methyl nucleotide
  modified_base 7: mod_base = OTHER; note = 2'-O-methyl nucleotide
  modified_base 8: mod_base = OTHER; note = 2'-fluoro nucleotide
  modified_base 9: mod_base = OTHER; note = 2'-fluoro nucleotide
  modified_base 10: mod_base = OTHER; note = 2'-fluoro nucleotide
  modified_base 11: mod_base = OTHER; note = 2'-fluoro nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-O-methyl nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide
  modified_base 21: mod_base = OTHER; note = 2'-O-methyl nucleotide
  modified_base 22: mod_base = OTHER; note = 2'-O-methyl nucleotide
  modified_base 23: mod_base = OTHER; note = 2'-O-methyl nucleotide
  modified_base 24: mod_base = OTHER; note = 2'-O-methyl nucleotide
  modified_base 25: mod_base = OTHER; note = 2'-O-methyl nucleotide
  modified_base 26: mod_base = OTHER; note = 2'-O-methyl nucleotide
  modified_base 27: mod_base = OTHER; note = 2'-O-methyl nucleotide
  modified_base 28: mod_base = OTHER; note 2'-aminodiethoxymethanol-Adenine-N-acetylgalactosamine
  modified_base 29: mod_base = OTHER; note 2'-aminodiethoxymethanol-Adenine-N-acetylgalactosamine
  modified_base 30: mod_base = OTHER; note 2'-aminodiethoxymethanol-Adenine-N-acetylgalactosamine
  modified_base 31: mod_base = OTHER; note = 2'-O-methyl nucleotide
  modified_base 32: mod_base = OTHER; note = 2'-O-methyl nucleotide
  modified_base 33: mod_base = OTHER; note = 2'-O-methyl nucleotide
  modified_base 34: mod_base = OTHER; note = 2'-O-methyl nucleotide
  modified_base 35: mod_base = OTHER; note = 2'-O-methyl nucleotide
  modified_base 36: mod_base = OTHER; note = 2'-O-methyl nucleotide

SEQ ID NO: 776 - RNA, 22 nt, synthetic construct
  source 1..22: mol_type = other RNA
  modified_base 1: mod_base = OTHER; note = 4'-O-monomethylphosphonate-2'-O-methyl-modified nucleotide
  modified_base 2: mod_base = OTHER; note = 2'-fluoro nucleotide phosphorothioate
  modified_base 3: mod_base = OTHER; note = 2'-fluoro nucleotide phosphorothioate
  modified_base 4: mod_base = OTHER; note = 2'-fluoro nucleotide
  modified_base 5: mod_base = OTHER; note = 2'-fluoro nucleotide
  modified_base 6: mod_base = OTHER; note = 2'-O-methyl nucleotide
  modified_base 7: mod_base = OTHER; note = 2'-fluoro nucleotide
  modified_base 8: mod_base = OTHER; note = 2'-O-methyl nucleotide
  modified_base 9: mod_base = OTHER; note = 2'-O-methyl nucleotide
  modified_base 10: mod_base = OTHER; note = 2'-fluoro nucleotide
  modified_base 11: mod_base = OTHER; note = 2'-O-methyl nucleotide
  modified_base 12: mod_base = OTHER; note = 2'-O-methyl nucleotide
  modified_base 13: mod_base = OTHER; note = 2'-O-methyl nucleotide
  modified_base 14: mod_base = OTHER; note = 2'-fluoro nucleotide
  modified_base 15: mod_base = OTHER; note = 2'-O-methyl nucleotide
  modified_base 16: mod_base = OTHER; note = 2'-O-methyl nucleotide
  modified_base 17: mod_base = OTHER; note = 2'-O-methyl nucleotide
  modified_base 18: mod_base = OTHER; note = 2'-O-methyl nucleotide
  modified_base 19: mod_base = OTHER; note = 2'-O-methyl nucleotide
  modified_base 20: mod_base = OTHER; note = 2'-O-methyl nucleotide phosphorothioate
  modified_base 21: mod_base = OTHER; note = 2'-O-methyl nucleotide phosphorothioate
  modified_base 22: mod_base = OTHER; note = 2'-O-methyl nucleotide
ttttaaaaaagtttaatattgg

SEQ ID NO: 777 - DNA, 19 bp, Homo sapiens
  source 1..19: mol_type = genomic DNA
acatcatcttgtttgccta

SEQ ID NO: 778 - DNA, 19 bp, Homo sapiens
  source 1..19: mol_type = genomic DNA
tcttgtttgcctacatcta

SEQ ID NO: 779 - DNA, 19 bp, Homo sapiens
  source 1..19: mol_type = genomic DNA
cttcagatgctgtttttca

SEQ ID NO: 780 - DNA, 19 bp, Homo sapiens
  source 1..19: mol_type = genomic DNA
cgctcttcagctattacaa

SEQ ID NO: 781 - DNA, 19 bp, Homo sapiens
  source 1..19: mol_type = genomic DNA
cttaattgacaccaacttt

SEQ ID NO: 782 - DNA, 19 bp, Homo sapiens
  source 1..19: mol_type = genomic DNA
tcaacggttcccttgattt

SEQ ID NO: 783 - DNA, 19 bp, Homo sapiens
  source 1..19: mol_type = genomic DNA
catcaagttctactccatt

SEQ ID NO: 784 - RNA, 16 nt, synthetic construct
  source 1..16: mol_type = other RNA
gcagccgaaaggctgc

SEQ ID NO: 785 - RNA, 19 nt, synthetic construct
  source 1..19: mol_type = other RNA
tgtttgcctacatctactt

SEQ ID NO: 786 - RNA, 19 nt, synthetic construct
  source 1..19: mol_type = other RNA
aagtagatgtaggcaaaca

SEQ ID NO: 787 - RNA, 19 nt, synthetic construct
  source 1..19: mol_type = other RNA
gtttgcctacatctacttc

SEQ ID NO: 788 - RNA, 19 nt, synthetic construct
  source 1..19: mol_type = other RNA
gaagtagatgtaggcaaac

SEQ ID NO: 789 - RNA, 19 nt, synthetic construct
  source 1..19: mol_type = other RNA
tttgcctacatctacttct

SEQ ID NO: 790 - RNA, 19 nt, synthetic construct
  source 1..19: mol_type = other RNA
agaagtagatgtaggcaaa

SEQ ID NO: 791 - RNA, 19 nt, synthetic construct
  source 1..19: mol_type = other RNA
gcctacatctacttctcca

SEQ ID NO: 792 - RNA, 19 nt, synthetic construct
  source 1..19: mol_type = other RNA
tggagaagtagatgtaggc

SEQ ID NO: 793 - RNA, 19 nt, synthetic construct
  source 1..19: mol_type = other RNA
aagatcgacatggtcaagt

SEQ ID NO: 794 - RNA, 19 nt, synthetic construct
  source 1..19: mol_type = other RNA
acttgaccatgtcgatctt

SEQ ID NO: 795 - RNA, 19 nt, synthetic construct
  source 1..19: mol_type = other RNA
agatcgacatggtcaagtc

SEQ ID NO: 796 - RNA, 19 nt, synthetic construct
  source 1..19: mol_type = other RNA
gacttgaccatgtcgatct

SEQ ID NO: 797 - RNA, 19 nt, synthetic construct
  source 1..19: mol_type = other RNA
atcgacatggtcaagtcca

SEQ ID NO: 798 - RNA, 19 nt, synthetic construct
  source 1..19: mol_type = other RNA
tggacttgaccatgtcgat

SEQ ID NO: 799 - RNA, 19 nt, synthetic construct
  source 1..19: mol_type = other RNA
gtgttggtgctcaccaagt

SEQ ID NO: 800 - RNA, 19 nt, synthetic construct
  source 1..19: mol_type = other RNA
acttggtgagcaccaacac

SEQ ID NO: 801 - RNA, 19 nt, synthetic construct
  source 1..19: mol_type = other RNA
tgttggtgctcaccaagtc

SEQ ID NO: 802 - RNA, 19 nt, synthetic construct
  source 1..19: mol_type = other RNA
gacttggtgagcaccaaca

SEQ ID NO: 803 - RNA, 19 nt, synthetic construct
  source 1..19: mol_type = other RNA
gagagctggtccatcatga

SEQ ID NO: 804 - RNA, 19 nt, synthetic construct
  source 1..19: mol_type = other RNA
tcatgatggaccagctctc

SEQ ID NO: 805 - RNA, 19 nt, synthetic construct
  source 1..19: mol_type = other RNA
agagctggtccatcatgaa

SEQ ID NO: 806 - RNA, 19 nt, synthetic construct
  source 1..19: mol_type = other RNA
ttcatgatggaccagctct

SEQ ID NO: 807 - RNA, 19 nt, synthetic construct
  source 1..19: mol_type = other RNA
gagctggtccatcatgaag

SEQ ID NO: 808 - RNA, 19 nt, synthetic construct
  source 1..19: mol_type = other RNA
cttcatgatggaccagctc

SEQ ID NO: 809 - RNA, 19 nt, synthetic construct
  source 1..19: mol_type = other RNA
agctggtccatcatgaaga

SEQ ID NO: 810 - RNA, 19 nt, synthetic construct
  source 1..19: mol_type = other RNA
tcttcatgatggaccagct

SEQ ID NO: 811 - RNA, 19 nt, synthetic construct
  source 1..19: mol_type = other RNA
gctggtccatcatgaagaa

SEQ ID NO: 812 - RNA, 19 nt, synthetic construct
  source 1..19: mol_type = other RNA
ttcttcatgatggaccagc

SEQ ID NO: 813 - RNA, 19 nt, synthetic construct
  source 1..19: mol_type = other RNA
ctggtccatcatgaagaac

SEQ ID NO: 814 - RNA, 19 nt, synthetic construct
  source 1..19: mol_type = other RNA
gttcttcatgatggaccag

SEQ ID NO: 815 - RNA, 19 nt, synthetic construct
  source 1..19: mol_type = other RNA
ccgttgtctggattggcat

SEQ ID NO: 816 - RNA, 19 nt, synthetic construct
  source 1..19: mol_type = other RNA
atgccaatccagacaacgg

SEQ ID NO: 817 - RNA, 19 nt, synthetic construct
  source 1..19: mol_type = other RNA
ttgtctggattggcatcct

SEQ ID NO: 818 - RNA, 19 nt, synthetic construct
  source 1..19: mol_type = other RNA
aggatgccaatccagacaa

SEQ ID NO: 819 - RNA, 19 nt, synthetic construct
  source 1..19: mol_type = other RNA
tgtctggattggcatcctg

SEQ ID NO: 820 - RNA, 19 nt, synthetic construct
  source 1..19: mol_type = other RNA
caggatgccaatccagaca

SEQ ID NO: 821 - RNA, 19 nt, synthetic construct
  source 1..19: mol_type = other RNA
gtctggattggcatcctgg

SEQ ID NO: 822 - RNA, 19 nt, synthetic construct
  source 1..19: mol_type = other RNA
ccaggatgccaatccagac

SEQ ID NO: 823 - RNA, 19 nt, synthetic construct
  source 1..19: mol_type = other RNA
ctggattggcatcctggta

SEQ ID NO: 824 - RNA, 19 nt, synthetic construct
  source 1..19: mol_type = other RNA
taccaggatgccaatccag

SEQ ID NO: 825 - RNA, 19 nt, synthetic construct
  source 1..19: mol_type = other RNA
tggattggcatcctggtat

SEQ ID NO: 826 - RNA, 19 nt, synthetic construct
  source 1..19: mol_type = other RNA
ataccaggatgccaatcca

SEQ ID NO: 827 - RNA, 19 nt, synthetic construct
  source 1..19: mol_type = other RNA
ggattggcatcctggtata

SEQ ID NO: 828 - RNA, 19 nt, synthetic construct
  source 1..19: mol_type = other RNA
tataccaggatgccaatcc

SEQ ID NO: 829 - RNA, 19 nt, synthetic construct
  source 1..19: mol_type = other RNA
gattggcatcctggtatac

SEQ ID NO: 830 - RNA, 19 nt, synthetic construct
  source 1..19: mol_type = other RNA
gtataccaggatgccaatc

SEQ ID NO: 831 - RNA, 19 nt, synthetic construct
  source 1..19: mol_type = other RNA
attggcatcctggtataca

SEQ ID NO: 832 - RNA, 19 nt, synthetic construct
  source 1..19: mol_type = other RNA
tgtataccaggatgccaat

SEQ ID NO: 833 - RNA, 19 nt, synthetic construct
  source 1..19: mol_type = other RNA
ctccatcttcccacctgat

SEQ ID NO: 834 - RNA, 19 nt, synthetic construct
  source 1..19: mol_type = other RNA
atcaggtgggaagatggag

SEQ ID NO: 835 - RNA, 19 nt, synthetic construct
  source 1..19: mol_type = other RNA
catctgcctgtgggatgta

SEQ ID NO: 836 - RNA, 19 nt, synthetic construct
  source 1..19: mol_type = other RNA
tacatcccacaggcagatg

SEQ ID NO: 837 - RNA, 19 nt, synthetic construct
  source 1..19: mol_type = other RNA
tctgcctgtgggatgtact

SEQ ID NO: 838 - RNA, 19 nt, synthetic construct
  source 1..19: mol_type = other RNA
agtacatcccacaggcaga

SEQ ID NO: 839 - RNA, 19 nt, synthetic construct
  source 1..19: mol_type = other RNA
gtggtgcaagcttgggtgt

SEQ ID NO: 840 - RNA, 19 nt, synthetic construct
  source 1..19: mol_type = other RNA
acacccaagcttgcaccac

SEQ ID NO: 841 - RNA, 19 nt, synthetic construct
  source 1..19: mol_type = other RNA
tggtgcaagcttgggtgtc

SEQ ID NO: 842 - RNA, 19 nt, synthetic construct
  source 1..19: mol_type = other RNA
gacacccaagcttgcacca

SEQ ID NO: 843 - RNA, 19 nt, synthetic construct
  source 1..19: mol_type = other RNA
ggtgcaagcttgggtgtca

SEQ ID NO: 844 - RNA, 19 nt, synthetic construct
  source 1..19: mol_type = other RNA
tgacacccaagcttgcacc

SEQ ID NO: 845 - RNA, 19 nt, synthetic construct
  source 1..19: mol_type = other RNA
gtgcaagcttgggtgtcat

SEQ ID NO: 846 - RNA, 19 nt, synthetic construct
  source 1..19: mol_type = other RNA
atgacacccaagcttgcac

SEQ ID NO: 847 - RNA, 19 nt, synthetic construct
  source 1..19: mol_type = other RNA
gcaagcttgggtgtcatct

SEQ ID NO: 848 - RNA, 19 nt, synthetic construct
  source 1..19: mol_type = other RNA
agatgacacccaagcttgc

SEQ ID NO: 849 - RNA, 19 nt, synthetic construct
  source 1..19: mol_type = other RNA
caagcttgggtgtcatctc

SEQ ID NO: 850 - RNA, 19 nt, synthetic construct
  source 1..19: mol_type = other RNA
gagatgacacccaagcttg

SEQ ID NO: 851 - RNA, 19 nt, synthetic construct
  source 1..19: mol_type = other RNA
aagcttgggtgtcatctca

SEQ ID NO: 852 - RNA, 19 nt, synthetic construct
  source 1..19: mol_type = other RNA
tgagatgacacccaagctt

SEQ ID NO: 853 - RNA, 19 nt, synthetic construct
  source 1..19: mol_type = other RNA
agcttgggtgtcatctcag

SEQ ID NO: 854 - RNA, 19 nt, synthetic construct
  source 1..19: mol_type = other RNA
ctgagatgacacccaagct

SEQ ID NO: 855 - RNA, 19 nt, synthetic construct
  source 1..19: mol_type = other RNA
gcttgggtgtcatctcaga

SEQ ID NO: 856 - RNA, 19 nt, synthetic construct
  source 1..19: mol_type = other RNA
tctgagatgacacccaagc

SEQ ID NO: 857 - RNA, 19 nt, synthetic construct
  source 1..19: mol_type = other RNA
gtgtctccttttgggacct

SEQ ID NO: 858 - RNA, 19 nt, synthetic construct
  source 1..19: mol_type = other RNA
aggtcccaaaaggagacac

SEQ ID NO: 859 - RNA, 19 nt, synthetic construct
  source 1..19: mol_type = other RNA
tgtctccttttgggaccta

SEQ ID NO: 860 - RNA, 19 nt, synthetic construct
  source 1..19: mol_type = other RNA
taggtcccaaaaggagaca

SEQ ID NO: 861 - RNA, 19 nt, synthetic construct
  source 1..19: mol_type = other RNA
ggggacctgttacagacag

SEQ ID NO: 862 - RNA, 19 nt, synthetic construct
  source 1..19: mol_type = other RNA
ctgtctgtaacaggtcccc

SEQ ID NO: 863 - RNA, 19 nt, synthetic construct
  source 1..19: mol_type = other RNA
gggacctgttacagacagt

SEQ ID NO: 864 - RNA, 19 nt, synthetic construct
  source 1..19: mol_type = other RNA
actgtctgtaacaggtccc

SEQ ID NO: 865 - RNA, 19 nt, synthetic construct
  source 1..19: mol_type = other RNA
ggacctgttacagacagtc

SEQ ID NO: 866 - RNA, 19 nt, synthetic construct
  source 1..19: mol_type = other RNA
gactgtctgtaacaggtcc

SEQ ID NO: 867 - RNA, 19 nt, synthetic construct
  source 1..19: mol_type = other RNA
gacctgttacagacagtct

SEQ ID NO: 868 - RNA, 19 nt, synthetic construct
  source 1..19: mol_type = other RNA
agactgtctgtaacaggtc

SEQ ID NO: 869 - RNA, 19 nt, synthetic construct
  source 1..19: mol_type = other RNA
acctgttacagacagtcta

SEQ ID NO: 870 - RNA, 19 nt, synthetic construct
  source 1..19: mol_type = other RNA
tagactgtctgtaacaggt

SEQ ID NO: 871 - RNA, 19 nt, synthetic construct
  source 1..19: mol_type = other RNA
tgccattgtctgcaacttt

SEQ ID NO: 872 - RNA, 19 nt, synthetic construct
  source 1..19: mol_type = other RNA
aaagttgcagacaatggca

SEQ ID NO: 873 - RNA, 19 nt, synthetic construct
  source 1..19: mol_type = other RNA
gccattgtctgcaactttg

SEQ ID NO: 874 - RNA, 19 nt, synthetic construct
  source 1..19: mol_type = other RNA
caaagttgcagacaatggc

SEQ ID NO: 875 - RNA, 19 nt, synthetic construct
  source 1..19: mol_type = other RNA
ccattgtctgcaactttgg

SEQ ID NO: 876 - RNA, 19 nt, synthetic construct
  source 1..19: mol_type = other RNA
ccaaagttgcagacaatgg

SEQ ID NO: 877 - RNA, 19 nt, synthetic construct
  source 1..19: mol_type = other RNA
attgtctgcaactttggca

SEQ ID NO: 878 - RNA, 19 nt, synthetic construct
  source 1..19: mol_type = other RNA
tgccaaagttgcagacaat

SEQ ID NO: 879 - RNA, 19 nt, synthetic construct
  source 1..19: mol_type = other RNA
tctgcaactttggcagtga

SEQ ID NO: 880 - RNA, 19 nt, synthetic construct
  source 1..19: mol_type = other RNA
tcactgccaaagttgcaga

SEQ ID NO: 881 - RNA, 19 nt, synthetic construct
  source 1..19: mol_type = other RNA
ctacccactgctgaaactc

SEQ ID NO: 882 - RNA, 19 nt, synthetic construct
  source 1..19: mol_type = other RNA
gagtttcagcagtgggtag

SEQ ID NO: 883 - RNA, 19 nt, synthetic construct
  source 1..19: mol_type = other RNA
gccaggaacaggacctgtg

SEQ ID NO: 884 - RNA, 19 nt, synthetic construct
  source 1..19: mol_type = other RNA
cacaggtcctgttcctggc

SEQ ID NO: 885 - RNA, 19 nt, synthetic construct
  source 1..19: mol_type = other RNA
gaacaggacctgtggaatt

SEQ ID NO: 886 - RNA, 19 nt, synthetic construct
  source 1..19: mol_type = other RNA
aattccacaggtcctgttc

SEQ ID NO: 887 - RNA, 19 nt, synthetic construct
  source 1..19: mol_type = other RNA
acaggacctgtggaattca

SEQ ID NO: 888 - RNA, 19 nt, synthetic construct
  source 1..19: mol_type = other RNA
tgaattccacaggtcctgt

SEQ ID NO: 889 - RNA, 19 nt, synthetic construct
  source 1..19: mol_type = other RNA
tggaattcaccacccctgt

SEQ ID NO: 890 - RNA, 19 nt, synthetic construct
  source 1..19: mol_type = other RNA
acaggggtggtgaattcca

SEQ ID NO: 891 - RNA, 19 nt, synthetic construct
  source 1..19: mol_type = other RNA
cttgtgaccacctacatca

SEQ ID NO: 892 - RNA, 19 nt, synthetic construct
  source 1..19: mol_type = other RNA
tgatgtaggtggtcacaag

SEQ ID NO: 893 - RNA, 19 nt, synthetic construct
  source 1..19: mol_type = other RNA
ttgtgaccacctacatcat

SEQ ID NO: 894 - RNA, 19 nt, synthetic construct
  source 1..19: mol_type = other RNA
atgatgtaggtggtcacaa

SEQ ID NO: 895 - RNA, 19 nt, synthetic construct
  source 1..19: mol_type = other RNA
tgtgaccacctacatcatc

SEQ ID NO: 896 - RNA, 19 nt, synthetic construct
  source 1..19: mol_type = other RNA
gatgatgtaggtggtcaca

SEQ ID NO: 897 - RNA, 19 nt, synthetic construct
  source 1..19: mol_type = other RNA
gtgaccacctacatcatct

SEQ ID NO: 898 - RNA, 19 nt, synthetic construct
  source 1..19: mol_type = other RNA
agatgatgtaggtggtcac

SEQ ID NO: 899 - RNA, 19 nt, synthetic construct
  source 1..19: mol_type = other RNA
tgaccacctacatcatctt

SEQ ID NO: 900 - RNA, 19 nt, synthetic construct
  source 1..19: mol_type = other RNA
aagatgatgtaggtggtca

SEQ ID NO: 901 - RNA, 19 nt, synthetic construct
  source 1..19: mol_type = other RNA
gaccacctacatcatcttg

SEQ ID NO: 902 - RNA, 19 nt, synthetic construct
  source 1..19: mol_type = other RNA
caagatgatgtaggtggtc

SEQ ID NO: 903 - RNA, 19 nt, synthetic construct
  source 1..19: mol_type = other RNA
accacctacatcatcttgt

SEQ ID NO: 904 - RNA, 19 nt, synthetic construct
  source 1..19: mol_type = other RNA
acaagatgatgtaggtggt

SEQ ID NO: 905 - RNA, 19 nt, synthetic construct
  source 1..19: mol_type = other RNA
ccacctacatcatcttgtt

SEQ ID NO: 906 - RNA, 19 nt, synthetic construct
  source 1..19: mol_type = other RNA
aacaagatgatgtaggtgg

SEQ ID NO: 907 - RNA, 19 nt, synthetic construct
  source 1..19: mol_type = other RNA
cacctacatcatcttgttt

SEQ ID NO: 908 - RNA, 19 nt, synthetic construct
  source 1..19: mol_type = other RNA
aaacaagatgatgtaggtg

SEQ ID NO: 909 - RNA, 19 nt, synthetic construct
  source 1..19: mol_type = other RNA
acctacatcatcttgtttg

SEQ ID NO: 910 - RNA, 19 nt, synthetic construct
  source 1..19: mol_type = other RNA
caaacaagatgatgtaggt

SEQ ID NO: 911 - RNA, 19 nt, synthetic construct
  source 1..19: mol_type = other RNA
cctacatcatcttgtttgc

SEQ ID NO: 912 - RNA, 19 nt, synthetic construct
  source 1..19: mol_type = other RNA
gcaaacaagatgatgtagg

SEQ ID NO: 913 - RNA, 19 nt, synthetic construct
  source 1..19: mol_type = other RNA
ctacatcatcttgtttgcc

SEQ ID NO: 914 - RNA, 19 nt, synthetic construct
  source 1..19: mol_type = other RNA
ggcaaacaagatgatgtag

SEQ ID NO: 915 - RNA, 19 nt, synthetic construct
  source 1..19: mol_type = other RNA
acatcatcttgtttgccta

SEQ ID NO: 916 - RNA, 19 nt, synthetic construct
  source 1..19: mol_type = other RNA
taggcaaacaagatgatgt

SEQ ID NO: 917 - RNA, 19 nt, synthetic construct
  source 1..19: mol_type = other RNA
atcatcttgtttgcctaca

SEQ ID NO: 918 - RNA, 19 nt, synthetic construct
  source 1..19: mol_type = other RNA
tgtaggcaaacaagatgat

SEQ ID NO: 919 - RNA, 19 nt, synthetic construct
  source 1..19: mol_type = other RNA
tcatcttgtttgcctacat

SEQ ID NO: 920 - RNA, 19 nt, synthetic construct
  source 1..19: mol_type = other RNA
atgtaggcaaacaagatga

SEQ ID NO: 921 - RNA, 19 nt, synthetic construct
  source 1..19: mol_type = other RNA
atcttgtttgcctacatct

SEQ ID NO: 922 - RNA, 19 nt, synthetic construct
  source 1..19: mol_type = other RNA
agatgtaggcaaacaagat

SEQ ID NO: 923 - RNA, 19 nt, synthetic construct
  source 1..19: mol_type = other RNA
tcttgtttgcctacatcta

SEQ ID NO: 924 - RNA, 19 nt, synthetic construct
  source 1..19: mol_type = other RNA
tagatgtaggcaaacaaga

SEQ ID NO: 925 - RNA, 19 nt, synthetic construct
  source 1..19: mol_type = other RNA
tttcccctaccttgtggtg

SEQ ID NO: 926 - RNA, 19 nt, synthetic construct
  source 1..19: mol_type = other RNA
caccacaaggtaggggaaa

SEQ ID NO: 927 - RNA, 19 nt, synthetic construct
  source 1..19: mol_type = other RNA
ttcccctaccttgtggtgg

SEQ ID NO: 928 - RNA, 19 nt, synthetic construct
  source 1..19: mol_type = other RNA
ccaccacaaggtaggggaa

SEQ ID NO: 929 - RNA, 19 nt, synthetic construct
  source 1..19: mol_type = other RNA
ccctaccttgtggtggtta

SEQ ID NO: 930 - RNA, 19 nt, synthetic construct
  source 1..19: mol_type = other RNA
taaccaccacaaggtaggg

SEQ ID NO: 931 - RNA, 19 nt, synthetic construct
  source 1..19: mol_type = other RNA
ctaccttgtggtggttatt

SEQ ID NO: 932 - RNA, 19 nt, synthetic construct
  source 1..19: mol_type = other RNA
aataaccaccacaaggtag

SEQ ID NO: 933 - RNA, 19 nt, synthetic construct
  source 1..19: mol_type = other RNA
taccttgtggtggttattg

SEQ ID NO: 934 - RNA, 19 nt, synthetic construct
  source 1..19: mol_type = other RNA
caataaccaccacaaggta

SEQ ID NO: 935 - RNA, 19 nt, synthetic construct
  source 1..19: mol_type = other RNA
accttgtggtggttattgg

SEQ ID NO: 936 - RNA, 19 nt, synthetic construct
  source 1..19: mol_type = other RNA
ccaataaccaccacaaggt

SEQ ID NO: 937 - RNA, 19 nt, synthetic construct
  source 1..19: mol_type = other RNA
ccttgtggtggttattggg

SEQ ID NO: 938 - RNA, 19 nt, synthetic construct
  source 1..19: mol_type = other RNA
cccaataaccaccacaagg

SEQ ID NO: 939 - RNA, 19 nt, synthetic construct
  source 1..19: mol_type = other RNA
cttgtggtggttattgggt

SEQ ID NO: 940 - RNA, 19 nt, synthetic construct
  source 1..19: mol_type = other RNA
acccaataaccaccacaag

SEQ ID NO: 941 - RNA, 19 nt, synthetic construct
  source 1..19: mol_type = other RNA
ttgtggtggttattgggtt

SEQ ID NO: 942 - RNA, 19 nt, synthetic construct
  source 1..19: mol_type = other RNA
aacccaataaccaccacaa

SEQ ID NO: 943 - RNA, 19 nt, synthetic construct
  source 1..19: mol_type = other RNA
tgtggtggttattgggtta

SEQ ID NO: 944 - RNA, 19 nt, synthetic construct
  source 1..19: mol_type = other RNA
taacccaataaccaccaca

SEQ ID NO: 945 - RNA, 19 nt, synthetic construct
  source 1..19: mol_type = other RNA
gtggtggttattgggttag

SEQ ID NO: 946 - RNA, 19 nt, synthetic construct
  source 1..19: mol_type = other RNA
ctaacccaataaccaccac

SEQ ID NO: 947 - RNA, 19 nt, synthetic construct
  source 1..19: mol_type = other RNA
tggtggttattgggttaga

SEQ ID NO: 948 - RNA, 19 nt, synthetic construct
  source 1..19: mol_type = other RNA
tctaacccaataaccacca

SEQ ID NO: 949 - RNA, 19 nt, synthetic construct
  source 1..19: mol_type = other RNA
ggtggttattgggttagag

SEQ ID NO: 950 - RNA, 19 nt, synthetic construct
  source 1..19: mol_type = other RNA
ctctaacccaataaccacc

SEQ ID NO: 951 - RNA, 19 nt, synthetic construct
  source 1..19: mol_type = other RNA
gtggttattgggttagaga

SEQ ID NO: 952 - RNA, 19 nt, synthetic construct
  source 1..19: mol_type = other RNA
tctctaacccaataaccac

SEQ ID NO: 953 - RNA, 19 nt, synthetic construct
  source 1..19: mol_type = other RNA
tggttattgggttagagaa

SEQ ID NO: 954 - RNA, 19 nt, synthetic construct
  source 1..19: mol_type = other RNA
ttctctaacccaataacca

SEQ ID NO: 955 - RNA, 19 nt, synthetic construct
  source 1..19: mol_type = other RNA
ggttattgggttagagaat

SEQ ID NO: 956 - RNA, 19 nt, synthetic construct
  source 1..19: mol_type = other RNA
attctctaacccaataacc

SEQ ID NO: 957 - RNA, 19 nt, synthetic construct
  source 1..19: mol_type = other RNA
gttattgggttagagaatg

SEQ ID NO: 958 - RNA, 19 nt, synthetic construct
  source 1..19: mol_type = other RNA
cattctctaacccaataac

SEQ ID NO: 959 - RNA, 19 nt, synthetic construct
  source 1..19: mol_type = other RNA
ttattgggttagagaatgt

SEQ ID NO: 960 - RNA, 19 nt, synthetic construct
  source 1..19: mol_type = other RNA
acattctctaacccaataa

SEQ ID NO: 961 - RNA, 19 nt, synthetic construct
  source 1..19: mol_type = other RNA
attgggttagagaatgtgt

SEQ ID NO: 962 - RNA, 19 nt, synthetic construct
  source 1..19: mol_type = other RNA
acacattctctaacccaat

SEQ ID NO: 963 - RNA, 19 nt, synthetic construct
  source 1..19: mol_type = other RNA
ttgggttagagaatgtgtt

SEQ ID NO: 964 - RNA, 19 nt, synthetic construct
  source 1..19: mol_type = other RNA
aacacattctctaacccaa

SEQ ID NO: 965 - RNA, 19 nt, synthetic construct
  source 1..19: mol_type = other RNA
ggttagagaatgtgttggt

SEQ ID NO: 966 - RNA, 19 nt, synthetic construct
  source 1..19: mol_type = other RNA
accaacacattctctaacc

SEQ ID NO: 967 - RNA, 19 nt, synthetic construct
  source 1..19: mol_type = other RNA
gttagagaatgtgttggtg

SEQ ID NO: 968 - RNA, 19 nt, synthetic construct
  source 1..19: mol_type = other RNA
caccaacacattctctaac

SEQ ID NO: 969 - RNA, 19 nt, synthetic construct
  source 1..19: mol_type = other RNA
ttagagaatgtgttggtgc

SEQ ID NO: 970 - RNA, 19 nt, synthetic construct
  source 1..19: mol_type = other RNA
gcaccaacacattctctaa

SEQ ID NO: 971 - RNA, 19 nt, synthetic construct
  source 1..19: mol_type = other RNA
tagagaatgtgttggtgct

SEQ ID NO: 972 - RNA, 19 nt, synthetic construct
  source 1..19: mol_type = other RNA
agcaccaacacattctcta

SEQ ID NO: 973 - RNA, 19 nt, synthetic construct
  source 1..19: mol_type = other RNA
agagaatgtgttggtgctc

SEQ ID NO: 974 - RNA, 19 nt, synthetic construct
  source 1..19: mol_type = other RNA
gagcaccaacacattctct

SEQ ID NO: 975 - RNA, 19 nt, synthetic construct
  source 1..19: mol_type = other RNA
gagaatgtgttggtgctca

SEQ ID NO: 976 - RNA, 19 nt, synthetic construct
  source 1..19: mol_type = other RNA
tgagcaccaacacattctc

SEQ ID NO: 977 - RNA, 19 nt, synthetic construct
  source 1..19: mol_type = other RNA
agaatgtgttggtgctcac

SEQ ID NO: 978 - RNA, 19 nt, synthetic construct
  source 1..19: mol_type = other RNA
gtgagcaccaacacattct

SEQ ID NO: 979 - RNA, 19 nt, synthetic construct
  source 1..19: mol_type = other RNA
aatgtgttggtgctcacca

SEQ ID NO: 980 - RNA, 19 nt, synthetic construct
  source 1..19: mol_type = other RNA
tggtgagcaccaacacatt

SEQ ID NO: 981 - RNA, 19 nt, synthetic construct
  source 1..19: mol_type = other RNA
atgtgttggtgctcaccaa

SEQ ID NO: 982 - RNA, 19 nt, synthetic construct
  source 1..19: mol_type = other RNA
ttggtgagcaccaacacat

SEQ ID NO: 983 - RNA, 19 nt, synthetic construct
  source 1..19: mol_type = other RNA
tgtgttggtgctcaccaag

SEQ ID NO: 984 - RNA, 19 nt, synthetic construct
  source 1..19: mol_type = other RNA
cttggtgagcaccaacaca

SEQ ID NO: 985 - RNA, 19 nt, synthetic construct
  source 1..19: mol_type = other RNA
tggtccatcatgaagaaca

SEQ ID NO: 986 - RNA, 19 nt, synthetic construct
  source 1..19: mol_type = other RNA
tgttcttcatgatggacca

SEQ ID NO: 987 - RNA, 19 nt, synthetic construct
  source 1..19: mol_type = other RNA
ggtccatcatgaagaacat

SEQ ID NO: 988 - RNA, 19 nt, synthetic construct
  source 1..19: mol_type = other RNA
atgttcttcatgatggacc

SEQ ID NO: 989 - RNA, 19 nt, synthetic construct
  source 1..19: mol_type = other RNA
ctgacttcttccttcagat

SEQ ID NO: 990 - RNA, 19 nt, synthetic construct
  source 1..19: mol_type = other RNA
atctgaaggaagaagtcag

SEQ ID NO: 991 - RNA, 19 nt, synthetic construct
  source 1..19: mol_type = other RNA
acttcttccttcagatgct

SEQ ID NO: 992 - RNA, 19 nt, synthetic construct
  source 1..19: mol_type = other RNA
agcatctgaaggaagaagt

SEQ ID NO: 993 - RNA, 19 nt, synthetic construct
  source 1..19: mol_type = other RNA
tccttcagatgctgttttt

SEQ ID NO: 994 - RNA, 19 nt, synthetic construct
  source 1..19: mol_type = other RNA
aaaaacagcatctgaagga

SEQ ID NO: 995 - RNA, 19 nt, synthetic construct
  source 1..19: mol_type = other RNA
ccttcagatgctgtttttc

SEQ ID NO: 996 - RNA, 19 nt, synthetic construct
  source 1..19: mol_type = other RNA
gaaaaacagcatctgaagg

SEQ ID NO: 997 - RNA, 19 nt, synthetic construct
  source 1..19: mol_type = other RNA
cttcagatgctgtttttca

SEQ ID NO: 998 - RNA, 19 nt, synthetic construct
  source 1..19: mol_type = other RNA
tgaaaaacagcatctgaag

SEQ ID NO: 999 - RNA, 19 nt, synthetic construct
  source 1..19: mol_type = other RNA
ttcagatgctgtttttcac

SEQ ID NO: 1000 - RNA, 19 nt, synthetic construct
  source 1..19: mol_type = other RNA
gtgaaaaacagcatctgaa

SEQ ID NO: 1001 - RNA, 19 nt, synthetic construct
  source 1..19: mol_type = other RNA
cagatgctgtttttcacca

SEQ ID NO: 1002 - RNA, 19 nt, synthetic construct
  source 1..19: mol_type = other RNA
tggtgaaaaacagcatctg

SEQ ID NO: 1003 - RNA, 19 nt, synthetic construct
  source 1..19: mol_type = other RNA
agatgctgtttttcaccac

SEQ ID NO: 1004 - RNA, 19 nt, synthetic construct
  source 1..19: mol_type = other RNA
gtggtgaaaaacagcatct

SEQ ID NO: 1005 - RNA, 19 nt, synthetic construct
  source 1..19: mol_type = other RNA
gatgctgtttttcaccact

SEQ ID NO: 1006 - RNA, 19 nt, synthetic construct
  source 1..19: mol_type = other RNA
agtggtgaaaaacagcatc

SEQ ID NO: 1007 - RNA, 19 nt, synthetic construct
  source 1..19: mol_type = other RNA
atgctgtttttcaccactg

SEQ ID NO: 1008 - RNA, 19 nt, synthetic construct
  source 1..19: mol_type = other RNA
cagtggtgaaaaacagcat

SEQ ID NO: 1009 - RNA, 19 nt, synthetic construct
  source 1..19: mol_type = other RNA
tgctgtttttcaccactgt

SEQ ID NO: 1010 - RNA, 19 nt, synthetic construct
  source 1..19: mol_type = other RNA
acagtggtgaaaaacagca

SEQ ID NO: 1011 - RNA, 19 nt, synthetic construct
  source 1..19: mol_type = other RNA
gctgtttttcaccactgtc

SEQ ID NO: 1012 - RNA, 19 nt, synthetic construct
  source 1..19: mol_type = other RNA
gacagtggtgaaaaacagc

SEQ ID NO: 1013 - RNA, 19 nt, synthetic construct
  source 1..19: mol_type = other RNA
tgtttttcaccactgtcct

SEQ ID NO: 1014 - RNA, 19 nt, synthetic construct
  source 1..19: mol_type = other RNA
aggacagtggtgaaaaaca

SEQ ID NO: 1015 - RNA, 19 nt, synthetic construct
  source 1..19: mol_type = other RNA
gtttttcaccactgtcctg

SEQ ID NO: 1016 - RNA, 19 nt, synthetic construct
  source 1..19: mol_type = other RNA
caggacagtggtgaaaaac

SEQ ID NO: 1017 - RNA, 19 nt, synthetic construct
  source 1..19: mol_type = other RNA
tttttcaccactgtcctgt

SEQ ID NO: 1018 - RNA, 19 nt, synthetic construct
  source 1..19: mol_type = other RNA
acaggacagtggtgaaaaa

SEQ ID NO: 1019 - RNA, 19 nt, synthetic construct
  source 1..19: mol_type = other RNA
ttttcaccactgtcctgtc

SEQ ID NO: 1020 - RNA, 19 nt, synthetic construct
  source 1..19: mol_type = other RNA
gacaggacagtggtgaaaa

SEQ ID NO: 1021 - RNA, 19 nt, synthetic construct
  source 1..19: mol_type = other RNA
ttcaccactgtcctgtcca

SEQ ID NO: 1022 - RNA, 19 nt, synthetic construct
  source 1..19: mol_type = other RNA
tggacaggacagtggtgaa

SEQ ID NO: 1023 - RNA, 19 nt, synthetic construct
  source 1..19: mol_type = other RNA
caccactgtcctgtccatt

SEQ ID NO: 1024 - RNA, 19 nt, synthetic construct
  source 1..19: mol_type = other RNA
aatggacaggacagtggtg

SEQ ID NO: 1025 - RNA, 19 nt, synthetic construct
  source 1..19: mol_type = other RNA
accactgtcctgtccattg

SEQ ID NO: 1026 - RNA, 19 nt, synthetic construct
  source 1..19: mol_type = other RNA
caatggacaggacagtggt

SEQ ID NO: 1027 - RNA, 19 nt, synthetic construct
  source 1..19: mol_type = other RNA
ccactgtcctgtccattga

SEQ ID NO: 1028 - RNA, 19 nt, synthetic construct
  source 1..19: mol_type = other RNA
tcaatggacaggacagtgg

SEQ ID NO: 1029 - RNA, 19 nt, synthetic construct
  source 1..19: mol_type = other RNA
cactgtcctgtccattgac

SEQ ID NO: 1030 - RNA, 19 nt, synthetic construct
  source 1..19: mol_type = other RNA
gtcaatggacaggacagtg

SEQ ID NO: 1031 - RNA, 19 nt, synthetic construct
  source 1..19: mol_type = other RNA
actgtcctgtccattgaca

SEQ ID NO: 1032 - RNA, 19 nt, synthetic construct
  source 1..19: mol_type = other RNA
tgtcaatggacaggacagt

SEQ ID NO: 1033 - RNA, 19 nt, synthetic construct
  source 1..19: mol_type = other RNA
ctaagctacctgagaacca

SEQ ID NO: 1034 - RNA, 19 nt, synthetic construct
  source 1..19: mol_type = other RNA
tggttctcaggtagcttag

SEQ ID NO: 1035 - RNA, 19 nt, synthetic construct
  source 1..19: mol_type = other RNA
gaggtccagcagaggttgt

SEQ ID NO: 1036 - RNA, 19 nt, synthetic construct
  source 1..19: mol_type = other RNA
acaacctctgctggacctc

SEQ ID NO: 1037 - RNA, 19 nt, synthetic construct
  source 1..19: mol_type = other RNA
gcagaggttgtccatgaca

SEQ ID NO: 1038 - RNA, 19 nt, synthetic construct
  source 1..19: mol_type = other RNA
tgtcatggacaacctctgc

SEQ ID NO: 1039 - RNA, 19 nt, synthetic construct
  source 1..19: mol_type = other RNA
cagaggttgtccatgacag

SEQ ID NO: 1040 - RNA, 19 nt, synthetic construct
  source 1..19: mol_type = other RNA
ctgtcatggacaacctctg

SEQ ID NO: 1041 - RNA, 19 nt, synthetic construct
  source 1..19: mol_type = other RNA
gaggatgaggaactttgga

SEQ ID NO: 1042 - RNA, 19 nt, synthetic construct
  source 1..19: mol_type = other RNA
tccaaagttcctcatcctc

SEQ ID NO: 1043 - RNA, 19 nt, synthetic construct
  source 1..19: mol_type = other RNA
gaactttggaggaaattgt

SEQ ID NO: 1044 - RNA, 19 nt, synthetic construct
  source 1..19: mol_type = other RNA
acaatttcctccaaagttc

SEQ ID NO: 1045 - RNA, 19 nt, synthetic construct
  source 1..19: mol_type = other RNA
gacgctcttcagctattac

SEQ ID NO: 1046 - RNA, 19 nt, synthetic construct
  source 1..19: mol_type = other RNA
gtaatagctgaagagcgtc

SEQ ID NO: 1047 - RNA, 19 nt, synthetic construct
  source 1..19: mol_type = other RNA
acgctcttcagctattaca

SEQ ID NO: 1048 - RNA, 19 nt, synthetic construct
  source 1..19: mol_type = other RNA
tgtaatagctgaagagcgt

SEQ ID NO: 1049 - RNA, 19 nt, synthetic construct
  source 1..19: mol_type = other RNA
cgctcttcagctattacaa

SEQ ID NO: 1050 - RNA, 19 nt, synthetic construct
  source 1..19: mol_type = other RNA
ttgtaatagctgaagagcg

SEQ ID NO: 1051 - RNA, 19 nt, synthetic construct
  source 1..19: mol_type = other RNA
gctcttcagctattacaac

SEQ ID NO: 1052 - RNA, 19 nt, synthetic construct
  source 1..19: mol_type = other RNA
gttgtaatagctgaagagc

SEQ ID NO: 1053 - RNA, 19 nt, synthetic construct
  source 1..19: mol_type = other RNA
ctcttcagctattacaaca

SEQ ID NO: 1054 - RNA, 19 nt, synthetic construct
  source 1..19: mol_type = other RNA
tgttgtaatagctgaagag

SEQ ID NO: 1055 - RNA, 19 nt, synthetic construct
  source 1..19: mol_type = other RNA
tcttcagctattacaacat

SEQ ID NO: 1056 - RNA, 19 nt, synthetic construct
  source 1..19: mol_type = other RNA
atgttgtaatagctgaaga

SEQ ID NO: 1057 - RNA, 19 nt, synthetic construct
  source 1..19: mol_type = other RNA
cttcagctattacaacatc

SEQ ID NO: 1058 - RNA, 19 nt, synthetic construct
  source 1..19: mol_type = other RNA
gatgttgtaatagctgaag

SEQ ID NO: 1059 - RNA, 19 nt, synthetic construct
  source 1..19: mol_type = other RNA
ttcagctattacaacatca

SEQ ID NO: 1060 - RNA, 19 nt, synthetic construct
  source 1..19: mol_type = other RNA
tgatgttgtaatagctgaa

SEQ ID NO: 1061 - RNA, 19 nt, synthetic construct
  source 1..19: mol_type = other RNA
ccagcctgacctcacctgc

SEQ ID NO: 1062 - RNA, 19 nt, synthetic construct
  source 1..19: mol_type = other RNA
gcaggtgaggtcaggctgg

SEQ ID NO: 1063 - RNA, 19 nt, synthetic construct
  source 1..19: mol_type = other RNA
cagcctgacctcacctgct

SEQ ID NO: 1064 - RNA, 19 nt, synthetic construct
  source 1..19: mol_type = other RNA
agcaggtgaggtcaggctg

SEQ ID NO: 1065 - RNA, 19 nt, synthetic construct
  source 1..19: mol_type = other RNA
agcctgacctcacctgctt

SEQ ID NO: 1066 - RNA, 19 nt, synthetic construct
  source 1..19: mol_type = other RNA
aagcaggtgaggtcaggct

SEQ ID NO: 1067 - RNA, 19 nt, synthetic construct
  source 1..19: mol_type = other RNA
gcctgacctcacctgctta

SEQ ID NO: 1068 - RNA, 19 nt, synthetic construct
  source 1..19: mol_type = other RNA
taagcaggtgaggtcaggc

SEQ ID NO: 1069 - RNA, 19 nt, synthetic construct
  source 1..19: mol_type = other RNA
cctgacctcacctgcttaa

SEQ ID NO: 1070 - RNA, 19 nt, synthetic construct
  source 1..19: mol_type = other RNA
ttaagcaggtgaggtcagg

SEQ ID NO: 1071 - RNA, 19 nt, synthetic construct
  source 1..19: mol_type = other RNA
ctgacctcacctgcttaat

SEQ ID NO: 1072 - RNA, 19 nt, synthetic construct
  source 1..19: mol_type = other RNA
attaagcaggtgaggtcag

SEQ ID NO: 1073 - RNA, 19 nt, synthetic construct
  source 1..19: mol_type = other RNA
tgacctcacctgcttaatt

SEQ ID NO: 1074 - RNA, 19 nt, synthetic construct
  source 1..19: mol_type = other RNA
aattaagcaggtgaggtca

SEQ ID NO: 1075 - RNA, 19 nt, synthetic construct
  source 1..19: mol_type = other RNA
gacctcacctgcttaattg

SEQ ID NO: 1076 - RNA, 19 nt, synthetic construct
  source 1..19: mol_type = other RNA
caattaagcaggtgaggtc

SEQ ID NO: 1077 - RNA, 19 nt, synthetic construct
  source 1..19: mol_type = other RNA
acctcacctgcttaattga

SEQ ID NO: 1078 - RNA, 19 nt, synthetic construct
  source 1..19: mol_type = other RNA
tcaattaagcaggtgaggt

SEQ ID NO: 1079 - RNA, 19 nt, synthetic construct
  source 1..19: mol_type = other RNA
cctcacctgcttaattgac

SEQ ID NO: 1080 - RNA, 19 nt, synthetic construct
  source 1..19: mol_type = other RNA
gtcaattaagcaggtgagg

SEQ ID NO: 1081 - RNA, 19 nt, synthetic construct
  source 1..19: mol_type = other RNA
ctcacctgcttaattgaca

SEQ ID NO: 1082 - RNA, 19 nt, synthetic construct
  source 1..19: mol_type = other RNA
tgtcaattaagcaggtgag

SEQ ID NO: 1083 - RNA, 19 nt, synthetic construct
  source 1..19: mol_type = other RNA
tcacctgcttaattgacac

SEQ ID NO: 1084 - RNA, 19 nt, synthetic construct
  source 1..19: mol_type = other RNA
gtgtcaattaagcaggtga

SEQ ID NO: 1085 - RNA, 19 nt, synthetic construct
  source 1..19: mol_type = other RNA
cacctgcttaattgacacc

SEQ ID NO: 1086 - RNA, 19 nt, synthetic construct
  source 1..19: mol_type = other RNA
ggtgtcaattaagcaggtg

SEQ ID NO: 1087 - RNA, 19 nt, synthetic construct
  source 1..19: mol_type = other RNA
acctgcttaattgacacca

SEQ ID NO: 1088 - RNA, 19 nt, synthetic construct
  source 1..19: mol_type = other RNA
tggtgtcaattaagcaggt

SEQ ID NO: 1089 - RNA, 19 nt, synthetic construct
  source 1..19: mol_type = other RNA
cctgcttaattgacaccaa

SEQ ID NO: 1090 - RNA, 19 nt, synthetic construct
  source 1..19: mol_type = other RNA
ttggtgtcaattaagcagg

SEQ ID NO: 1091 - RNA, 19 nt, synthetic construct
  source 1..19: mol_type = other RNA
ctgcttaattgacaccaac

SEQ ID NO: 1092 - RNA, 19 nt, synthetic construct
  source 1..19: mol_type = other RNA
gttggtgtcaattaagcag

SEQ ID NO: 1093 - RNA, 19 nt, synthetic construct
  source 1..19: mol_type = other RNA
tgcttaattgacaccaact

SEQ ID NO: 1094 - RNA, 19 nt, synthetic construct
  source 1..19: mol_type = other RNA
agttggtgtcaattaagca

SEQ ID NO: 1095 - RNA, 19 nt, synthetic construct
  source 1..19: mol_type = other RNA
gcttaattgacaccaactt

SEQ ID NO: 1096 - RNA, 19 nt, synthetic construct
  source 1..19: mol_type = other RNA
aagttggtgtcaattaagc

SEQ ID NO: 1097 - RNA, 19 nt, synthetic construct
  source 1..19: mol_type = other RNA
cttaattgacaccaacttt

SEQ ID NO: 1098 - RNA, 19 nt, synthetic construct
  source 1..19: mol_type = other RNA
aaagttggtgtcaattaag

SEQ ID NO: 1099 - RNA, 19 nt, synthetic construct
  source 1..19: mol_type = other RNA
ttaattgacaccaactttt

SEQ ID NO: 1100 - RNA, 19 nt, synthetic construct
  source 1..19: mol_type = other RNA
aaaagttggtgtcaattaa

SEQ ID NO: 1101 - RNA, 19 nt, synthetic construct
  source 1..19: mol_type = other RNA
taattgacaccaacttttc

SEQ ID NO: 1102 - RNA, 19 nt, synthetic construct
  source 1..19: mol_type = other RNA
gaaaagttggtgtcaatta

SEQ ID NO: 1103 - RNA, 19 nt, synthetic construct
  source 1..19: mol_type = other RNA
attgaaggggtgctgtgct

SEQ ID NO: 1104 - RNA, 19 nt, synthetic construct
  source 1..19: mol_type = other RNA
agcacagcaccccttcaat

SEQ ID NO: 1105 - RNA, 19 nt, synthetic construct
  source 1..19: mol_type = other RNA
cttggacaaaaggattgtg

SEQ ID NO: 1106 - RNA, 19 nt, synthetic construct
  source 1..19: mol_type = other RNA
cacaatccttttgtccaag

SEQ ID NO: 1107 - RNA, 19 nt, synthetic construct
  source 1..19: mol_type = other RNA
ttggacaaaaggattgtgg

SEQ ID NO: 1108 - RNA, 19 nt, synthetic construct
  source 1..19: mol_type = other RNA
ccacaatccttttgtccaa

SEQ ID NO: 1109 - RNA, 19 nt, synthetic construct
  source 1..19: mol_type = other RNA
tcaacggttcccttgattt

SEQ ID NO: 1110 - RNA, 19 nt, synthetic construct
  source 1..19: mol_type = other RNA
aaatcaagggaaccgttga

SEQ ID NO: 1111 - RNA, 19 nt, synthetic construct
  source 1..19: mol_type = other RNA
caacggttcccttgatttc

SEQ ID NO: 1112 - RNA, 19 nt, synthetic construct
  source 1..19: mol_type = other RNA
gaaatcaagggaaccgttg

SEQ ID NO: 1113 - RNA, 19 nt, synthetic construct
  source 1..19: mol_type = other RNA
aacggttcccttgatttct

SEQ ID NO: 1114 - RNA, 19 nt, synthetic construct
  source 1..19: mol_type = other RNA
agaaatcaagggaaccgtt

SEQ ID NO: 1115 - RNA, 19 nt, synthetic construct
  source 1..19: mol_type = other RNA
acggttcccttgatttctt

SEQ ID NO: 1116 - RNA, 19 nt, synthetic construct
  source 1..19: mol_type = other RNA
aagaaatcaagggaaccgt

SEQ ID NO: 1117 - RNA, 19 nt, synthetic construct
  source 1..19: mol_type = other RNA
gtacattgaccagaccatg

SEQ ID NO: 1118 - RNA, 19 nt, synthetic construct
  source 1..19: mol_type = other RNA
catggtctggtcaatgtac

SEQ ID NO: 1119 - RNA, 19 nt, synthetic construct
  source 1..19: mol_type = other RNA
acctgtaccacctcctgtg

SEQ ID NO: 1120 - RNA, 19 nt, synthetic construct
  source 1..19: mol_type = other RNA
cacaggaggtggtacaggt

SEQ ID NO: 1121 - RNA, 19 nt, synthetic construct
  source 1..19: mol_type = other RNA
cctgtaccacctcctgtgt

SEQ ID NO: 1122 - RNA, 19 nt, synthetic construct
  source 1..19: mol_type = other RNA
acacaggaggtggtacagg

SEQ ID NO: 1123 - RNA, 19 nt, synthetic construct
  source 1..19: mol_type = other RNA
gtaccacctcctgtgtcat

SEQ ID NO: 1124 - RNA, 19 nt, synthetic construct
  source 1..19: mol_type = other RNA
atgacacaggaggtggtac

SEQ ID NO: 1125 - RNA, 19 nt, synthetic construct
  source 1..19: mol_type = other RNA
gcacaggcatcaagttcta

SEQ ID NO: 1126 - RNA, 19 nt, synthetic construct
  source 1..19: mol_type = other RNA
tagaacttgatgcctgtgc

SEQ ID NO: 1127 - RNA, 19 nt, synthetic construct
  source 1..19: mol_type = other RNA
acaggcatcaagttctact

SEQ ID NO: 1128 - RNA, 19 nt, synthetic construct
  source 1..19: mol_type = other RNA
agtagaacttgatgcctgt

SEQ ID NO: 1129 - RNA, 19 nt, synthetic construct
  source 1..19: mol_type = other RNA
caggcatcaagttctactc

SEQ ID NO: 1130 - RNA, 19 nt, synthetic construct
  source 1..19: mol_type = other RNA
gagtagaacttgatgcctg

SEQ ID NO: 1131 - RNA, 19 nt, synthetic construct
  source 1..19: mol_type = other RNA
aggcatcaagttctactcc

SEQ ID NO: 1132 - RNA, 19 nt, synthetic construct
  source 1..19: mol_type = other RNA
ggagtagaacttgatgcct

SEQ ID NO: 1133 - RNA, 19 nt, synthetic construct
  source 1..19: mol_type = other RNA
ggcatcaagttctactcca

SEQ ID NO: 1134 - RNA, 19 nt, synthetic construct
  source 1..19: mol_type = other RNA
tggagtagaacttgatgcc

SEQ ID NO: 1135 - RNA, 19 nt, synthetic construct
  source 1..19: mol_type = other RNA
gcatcaagttctactccat

SEQ ID NO: 1136 - RNA, 19 nt, synthetic construct
  source 1..19: mol_type = other RNA
atggagtagaacttgatgc

SEQ ID NO: 1137 - RNA, 19 nt, synthetic construct
  source 1..19: mol_type = other RNA
catcaagttctactccatt

SEQ ID NO: 1138 - RNA, 19 nt, synthetic construct
  source 1..19: mol_type = other RNA
aatggagtagaacttgatg

SEQ ID NO: 1139 - RNA, 19 nt, synthetic construct
  source 1..19: mol_type = other RNA
atcaagttctactccattc

SEQ ID NO: 1140 - RNA, 19 nt, synthetic construct
  source 1..19: mol_type = other RNA
gaatggagtagaacttgat

SEQ ID NO: 1141 - RNA, 19 nt, synthetic construct
  source 1..19: mol_type = other RNA
tcaagttctactccattca

SEQ ID NO: 1142 - RNA, 19 nt, synthetic construct
  source 1..19: mol_type = other RNA
tgaatggagtagaacttga

SEQ ID NO: 1143 - RNA, 19 nt, synthetic construct
  source 1..19: mol_type = other RNA
caagttctactccattcag

SEQ ID NO: 1144 - RNA, 19 nt, synthetic construct
  source 1..19: mol_type = other RNA
ctgaatggagtagaacttg

SEQ ID NO: 1145 - RNA, 19 nt, synthetic construct
  source 1..19: mol_type = other RNA
aagttctactccattcagc

SEQ ID NO: 1146 - RNA, 19 nt, synthetic construct
  source 1..19: mol_type = other RNA
gctgaatggagtagaactt

SEQ ID NO: 1147 - RNA, 19 nt, synthetic construct
  source 1..19: mol_type = other RNA
agttctactccattcagca

SEQ ID NO: 1148 - RNA, 19 nt, synthetic construct
  source 1..19: mol_type = other RNA
tgctgaatggagtagaact

SEQ ID NO: 1149 - RNA, 19 nt, synthetic construct
  source 1..19: mol_type = other RNA
gttctactccattcagcag

SEQ ID NO: 1150 - RNA, 19 nt, synthetic construct
  source 1..19: mol_type = other RNA
ctgctgaatggagtagaac

SEQ ID NO: 1151 - RNA, 19 nt, synthetic construct
  source 1..19: mol_type = other RNA
gtgtcatctcagacaacct

SEQ ID NO: 1152 - RNA, 19 nt, synthetic construct
  source 1..19: mol_type = other RNA
aggttgtctgagatgacac

SEQ ID NO: 1153 - RNA, 19 nt, synthetic construct
  source 1..19: mol_type = other RNA
catctcagacaacctgctg

SEQ ID NO: 1154 - RNA, 19 nt, synthetic construct
  source 1..19: mol_type = other RNA
cagcaggttgtctgagatg

SEQ ID NO: 1155 - RNA, 19 nt, synthetic construct
  source 1..19: mol_type = other RNA
tcagacaacctgctggtga

SEQ ID NO: 1156 - RNA, 19 nt, synthetic construct
  source 1..19: mol_type = other RNA
tcaccagcaggttgtctga

SEQ ID NO: 1157 - RNA, 19 nt, synthetic construct
  source 1..19: mol_type = other RNA
cggggacctgttacagaca

SEQ ID NO: 1158 - RNA, 19 nt, synthetic construct
  source 1..19: mol_type = other RNA
tgtctgtaacaggtccccg

SEQ ID NO: 1159 - RNA, 19 nt, synthetic construct
  source 1..19: mol_type = other RNA
gacaacgctgccattgtct

SEQ ID NO: 1160 - RNA, 19 nt, synthetic construct
  source 1..19: mol_type = other RNA
agacaatggcagcgttgtc

SEQ ID NO: 1161 - RNA, 19 nt, synthetic construct
  source 1..19: mol_type = other RNA
gctgcctcctgactgtaat

SEQ ID NO: 1162 - RNA, 19 nt, synthetic construct
  source 1..19: mol_type = other RNA
attacagtcaggaggcagc

SEQ ID NO: 1163 - RNA, 19 nt, synthetic construct
  source 1..19: mol_type = other RNA
ctgcctcctgactgtaata

SEQ ID NO: 1164 - RNA, 19 nt, synthetic construct
  source 1..19: mol_type = other RNA
tattacagtcaggaggcag

SEQ ID NO: 1165 - RNA, 19 nt, synthetic construct
  source 1..19: mol_type = other RNA
taatattaaacttttttaa

SEQ ID NO: 1166 - RNA, 19 nt, synthetic construct
  source 1..19: mol_type = other RNA
ttaaaaaagtttaatatta

SEQ ID NO: 1167 - RNA, 19 nt, synthetic construct
  source 1..19: mol_type = other RNA
aatattaaacttttttaaa

SEQ ID NO: 1168 - RNA, 19 nt, synthetic construct
  source 1..19: mol_type = other RNA
tttaaaaaagtttaatatt

SEQ ID NO: 1169 - protein, 5 aa, synthetic construct
CREKA

The invention claimed is:

1. An RNAi oligonucleotide for modulating sterol regulatory element-binding protein (SREBP) cleavage-activating protein (SCAP) activity, the RNAi oligonucleotide comprising a sense strand forming a duplex region with an antisense strand, wherein:

the sense strand comprises a nucleotide sequence as set forth in sequence: 5'-UCAACGGUUCCCUUGAUUUAGCAGCCGAAAGGCUGC-3' (SEQ ID NO: 333); and the antisense strand comprises a nucleotide sequence as set forth in sequence: 5'-UAAAUCAAGGGAACCGUUGAGG-3' (SEQ ID NO: 334).

2. The RNAi oligonucleotide of claim 1, wherein the RNAi oligonucleotide comprises at least one modified nucleotide.

3. The RNAi oligonucleotide of claim 2, wherein the modified nucleotide comprises a 2'-modification.

4. The RNAi oligonucleotide of claim 1, wherein all nucleotides of the RNAi oligonucleotide are modified.

5. The RNAi oligonucleotide of claim 1, wherein the RNAi oligonucleotide comprises at least one modified internucleotide linkage.

6. The RNAi oligonucleotide of claim 1, wherein the 4'-carbon of the sugar of the 5'-nucleotide of the antisense strand comprises a phosphate analog.

7. The RNAi oligonucleotide of claim 1, wherein at least one nucleotide of the RNAi oligonucleotide is conjugated to one or more targeting ligands.

8. The RNAi oligonucleotide of claim 7, wherein each targeting ligand comprises a N-acetylgalactosamine (GalNAc) moiety.

9. The RNAi oligonucleotide of claim 1 wherein up to 4 nucleotides of a stem-loop of the RNAi oligonucleotide are each conjugated to a monovalent GalNAc moiety.

10. The RNAi oligonucleotide of claim 3, wherein the 2'-modification is a modification selected from 2'-aminoethyl, 2'-fluoro (2'-F), 2'-O-methyl (2'-OMe), 2'-O-methoxyethyl (2'-MOE), and 2'-deoxy-2'-fluoro-β-d-arabinonucleic acid (2'-FANA).

11. The RNAi oligonucleotide of claim 3, wherein the 2'-modification is a modification selected from the group consisting of 2'-F and 2'-OMe.

12. The RNAi oligonucleotide of claim 5, wherein the at least one modified internucleotide linkage is a phosphorothioate linkage.

13. The RNAi oligonucleotide of claim 6, wherein the phosphate analog is oxymethylphosphonate, vinyl phosphonate or malonylphosphonate.

14. The RNAi oligonucleotide of claim 6, wherein the phosphate analog is a 4'-phosphate analog comprising 5'-methoxyphosphonate-4'-oxy.

15. The RNAi oligonucleotide of claim 8, wherein the GalNAc moiety is a monovalent GalNAc moiety, a bivalent GalNAc moiety, a trivalent GalNAc moiety, or a tetravalent GalNAc moiety.

16. The RNAi oligonucleotide of claim 7, wherein each targeting ligand comprises a carbohydrate, ammo sugar, cholesterol, polypeptide or lipid.

17. The RNAi oligonucleotide of claim 1, wherein the sense strand comprises a nucleotide sequence as set forth in SEQ ID NO: 717, and the antisense strand comprises a nucleotide sequence as set forth in SEQ ID NO: 718.

18. A pharmaceutical composition comprising:

(i) the RNAi oligonucleotide of claim 1, or a pharmaceutically acceptable salt thereof; and (ii) a pharmaceutically acceptable carrier, delivery agent or excipient.

19. The pharmaceutical composition of claim 18, wherein the pharmaceutically acceptable carrier comprises water.

20. The pharmaceutical composition of claim 18, wherein the pharmaceutically acceptable carrier comprises phosphate buffered saline.

* * * * *